(12) United States Patent
Sanz Molinero et al.

(10) Patent No.: US 8,802,928 B2
(45) Date of Patent: Aug. 12, 2014

(54) PLANTS HAVING ENHANCED YIELD-RELATED TRAITS AND/OR INCREASED ABIOTIC STRESS RESISTANCE, AND A METHOD FOR MAKING THE SAME

(75) Inventors: Ana Isabel Sanz Molinero, Gentbrugge (BE); Valerie Frankard, Waterloo (BE); Yves Hatzfeld, Lille (FR); Christophe Reuzeau, Tocan Saint Apre (FR)

(73) Assignee: BASF Plant Science GmbH, Ludwigshafen (DE)

( * ) Notice: Subject to any disclaimer, the term of this patent is extended or adjusted under 35 U.S.C. 154(b) by 544 days.

(21) Appl. No.: 12/524,867

(22) PCT Filed: Jan. 31, 2008

(86) PCT No.: PCT/EP2008/051225
§ 371 (c)(1),
(2), (4) Date: Sep. 11, 2009

(87) PCT Pub. No.: WO2008/092935
PCT Pub. Date: Aug. 7, 2008

(65) Prior Publication Data
US 2010/0199379 A1 Aug. 5, 2010

Related U.S. Application Data

(60) Provisional application No. 60/891,271, filed on Feb. 23, 2007, provisional application No. 60/896,059, filed on Mar. 21, 2007, provisional application No. 60/911,089, filed on Apr. 11, 2007, provisional application No. 60/911,289, filed on Apr. 12, 2007, provisional application No. 60/910,874, filed on Apr. 10, 2007.

(30) Foreign Application Priority Data

Jan. 31, 2007 (EP) .................... 07101533
Feb. 28, 2007 (EP) .................... 07103194
Mar. 14, 2007 (EP) .................... 07104172
Mar. 15, 2007 (EP) .................... 07104194
Mar. 15, 2007 (EP) .................... 07104242

(51) Int. Cl.
*A01H 1/04* (2006.01)
*A01H 5/10* (2006.01)
*C12N 15/29* (2006.01)
*C07H 21/04* (2006.01)

(52) U.S. Cl.
USPC .......... 800/290; 800/298; 435/268; 536/23.6; 536/24.1

(58) Field of Classification Search
None
See application file for complete search history.

(56) References Cited

U.S. PATENT DOCUMENTS 7,790,956 B2 * 9/2010 Dudits et al. .................. 800/290
2003/0233670 A1 12/2003 Edgerton et al.
2004/0034888 A1 2/2004 Liu et al.

FOREIGN PATENT DOCUMENTS

| EP | WO 2005/094562 | * 10/2005 | ............... A01H 5/00 |
|---|---|---|---|
| WO | WO-01/23594 A2 | 4/2001 | |
| WO | WO-2005/085449 A2 | 9/2005 | |
| WO | WO-2005/094562 A1 | 10/2005 | |
| WO | WO-2006/004955 A2 | 1/2006 | |

OTHER PUBLICATIONS

Tamura T et al. Osmotic stress tolerance of transgenic tobacco expressing a gene encoding a membrane-located receptor-like protein from tobacco plants. Plant Physiol. Feb. 2003;131(2):454-62.*
Zhou et al. The plant cyclin-dependent kinase inhibitor ICK1 has distinct functional domains for in vivo kinase inhibition, protein instability and nuclear localization. Plant J. Aug. 2003;35(4):476-89.*
Tani et al. Activation tagging in plants: a tool for gene discovery. Funct Integr Genomics. Oct. 2004;4(4):258-66. Epub May 20, 2004.*
Pennycooke et al. Down-regulating alpha-galactosidase enhances freezing tolerance in transgenic petunia. Plant Physiol. Oct. 2003;133(2):901-9. Epub Sep. 18, 2003.*
Dong et al. Regulation of biosynthesis and intracellular localization of rice and tobacco homologues of nucleosome assembly protein 1. Planta. Feb. 2003;216(4):561-70. Epub Oct. 10, 2002.*
Zhu, Y., et al., "*Arabidopsis NRP1* and *NRP2* Encode Histone Chaperones and are Required for Maintaining Postembryonic Root Growth", The Plant Cell, vol. 18, (2006), pp. 2879-2892.

(Continued)

*Primary Examiner* — Cynthia Collins
*Assistant Examiner* — Matthew Keogh
(74) *Attorney, Agent, or Firm* — Drinker Biddle & Reath LLP

(57) ABSTRACT

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding a Yield Enhancing Protein (YEP). The YEP is selected from a Nucleosome Assembly Protein 1-like polypeptide (NAP1-like), a Like Sm polypeptide (Lsm protein), a truncated Cyclin H ($CycH_{Tr}$) polypeptide, a Remorin polypeptide, and a DREB protein. The present invention also concerns plants having modulated expression of a nucleic acid encoding such a YEP, which plants have enhanced yield-related traits relative to control plants. The invention also provides hitherto unknown YEP-encoding nucleic acids, and constructs comprising the same, useful in performing the methods of the invention.

17 Claims, 150 Drawing Sheets

(56) References Cited

OTHER PUBLICATIONS

Xiong, L., et al., "Modulation of Abscisic Acid Signal Transduction and Biosynthesis by an Sm-Like Protein in *Arabidopsis*", Developmental Cell, vol. 1, (2001), pp. 771-781.

Dong, A. et al., "Interacting Proteins and Differences in Nuclear Transport Reveal Specific Functions for the NAP1 Family Proteins in Plants", Plant Physiology, vol. 138, (2005), pp. 1446-1456.

Alliotte, T., et al., "An Auxin-Regulated Gene of *Arabidopsis thaliana* Encodes a DNA-Binding Protein", Plant Physiology, 1989, vol. 89, pp. 743-752.

Andersen, G., et al., "The Structure of Cyclin H: Common Mode of Kinase Activation and Specific Features", The EMBO Journal, 1997, vol. 16, pp. 958-967.

Bariola, P., et al., "Remorins form a Novel Family of Coiled Coil-Forming Oligomeric and Filamentous Proteins Associated with Apical, Vascular and Embryonic Tissues in Plants", Plant Molecular Biology, 2004, vol. 55, pp. 579-594.

Deeks, M. J., et al., "*Arabidopsis* NAP1 Is Essential for Arp2/3-Dependent Trichome Morphogenesis", Current Biology, 2004, vol. 14, pp. 1410-1414.

Glanz, S., et al., "A Nucleosome Assembly Protein-Like Polypeptide Binds to Chloroplast Group II Intron RNA in *Chlamydomonas reinhardtii*", Nucleic Acids Research, 2006, vol. 34, No. 18, pp. 5337-5351.

"*Arabidopsis thaliana* Putative Protein (T8H10.14) mRNA, Complete cds", EMBL Database Accession No. AY059900, Nov. 5, 2001.

"SubName: Full=Putative Uncharacterized Protein At3g57540", Uniprot Database Accession No. Q93YN8, Dec. 1, 2001.

Reymond, P., et al., "Cloning of a cDNA Encoding a Plasma Membrane-Associated, Uronide Binding Phosphoprotein with Physical Properties Similar to Viral Movement Proteins", The Plant Cell, 1996, vol. 8, pp. 2265-2276.

Shimotohno, A., et al., "Diverse Phosphoregulatory Mechanisms Controlling Cyclin-Dependent Kinase-Activating Kinases in *Arabidopsis*", The Plant Journal, 2006, vol. 47, pp. 701-710.

Yamaguchi, M., et al., "Control of In Vitro Organogenesis by Cyclin-Dependent Kinase Activities in Plants", PNAS, 2003, vol. 100, No. 13, pp. 8019-8023.

Yoon, H. W., et al., "Molecular Cloning and Functional Characterization of a cDNA Encoding Nucleosome Assembly Protein 1 (NAP-1) from Soybean", Molecular and General Genetics, 1995, vol. 249, pp. 465-473.

\* cited by examiner

MVADKSKKSKIEEKGEEENLEQIDAELVLS**IEKLQEIQDDLEKINEKASDEVLEVE
QKYNVIRKPVYDKRNEVIQSIPGFWMTAFLSHPALGDLLTEEDQKIFKYLNSLEVE
DAKDVKSGYSITFHFTSNPFFEDAKLTKTFTFLEEGTTKITATPIKWKEGKGLPNG
VNHDDKKGNKRALPEESFFTWFTDAQHKEDAGDEIHDEVADIIKEDLWSNPLTYFN
NDADE**EDFDGDDDGDEEGEEDDDDEEEEDGEE

A

MSNDKDSMNMSDLSTALNEEDRAGLVNALKNKLQNLAGQHSDVLENLTPPV**RKRVE
FLREIQNQYDEMEAKFFEERAALEAKYQKLYQPLYTKRYEIVNGVVEVEGAAEEVK
SEQGEDKSAEEKGVPDFWLIALKNNEITAEEITERDEGALKYLKDIKWSRVEEPKG
FKLEFFFDQNPYFKNTVLTKTYHMIDEDEPILEKALGTEIEWYPGKCLTQKILKKK
PKKGSKNTKPITKTEDCESFFNFFSPPQVPDDDEDLDDDMADELQGQMEHDYDIGS
TIKEKIISHAVSWFTGEAVE**ADDLDIEDDDDEIDEDDDEEDEEDDEDDEEEDDEDD
DEEEEADQGKKSKKKSSAGHKKAGRSQLAEGQAGERPPECKQQ

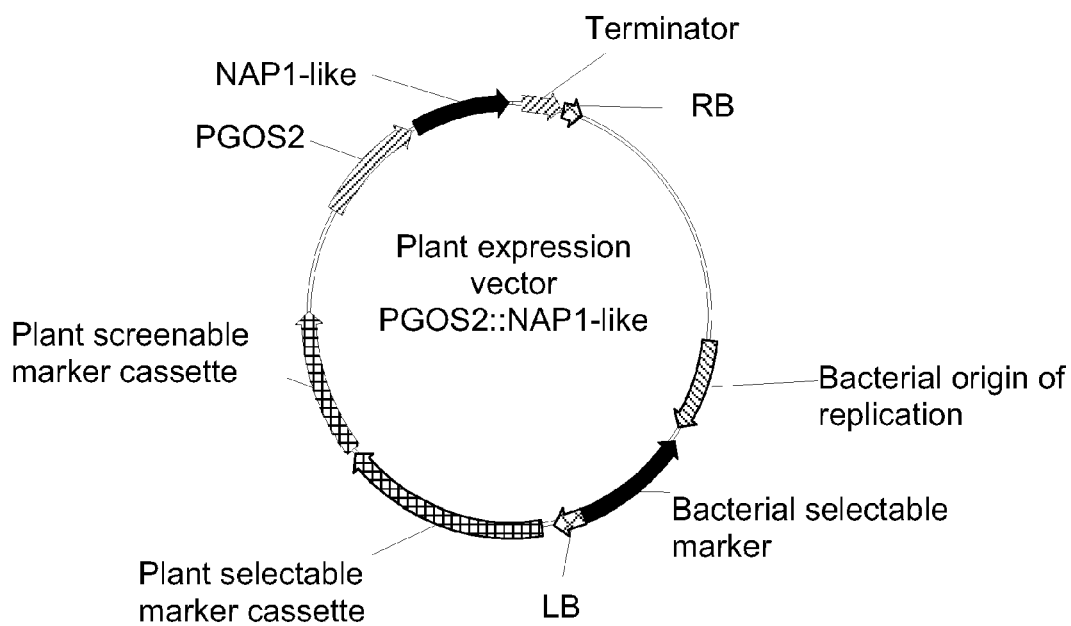

```
SEQID13  -----------------------------MTAPADKGKKAKTDADG--GEE
SEQID19  -----------------------------MTAPADKGKKAKTDADG--GEE
SEQID17  -----------------------------MTAPADKGKKAKTDADGGAAEE
SEQID15  -----------------------------MAAAEQKGKKPRTDGAEA---
SEQID9   -----------------------------MGADKGKKQKVDEEN------
SEQID23  -----------------------------MVVDKGKKQKVEEE-------
SEQID7   -----------------------------MGADKGKKQKVEEEN------
SEQID2   -----------------------------MVADKSKKKSKIEEKGE--EEN
SEQID21  -----------------------------MVTDKSKKKAKTE----EEN
SEQID11  -----------------------------MVADKSKKLKVSEKG---EN
SEQID25  ---------------MSNDKDSFNVSDLTAALKDEDRAGLVNALKNKLQNLAGQRSDV
SEQID29  ---------------MSNDKDSFNVSDLTSALKDEDRAGLVNALKNKLQNLAGQHSDV
SEQID27  ---------------MSNDKDSMNMSDLSTALNEEDRAGLVNALKNKLQNLAGQHSDV
SEQID36  ---------------MTNNKEAFNISDLSSALNEEDRADLVNALKSKIQSLAGQHSDV
SEQID38  ---------------MTNDNIAVTDLTSALNEENRADLVNALKSKIQSLAGAHSDV
SEQID31  MSNEENIKSDNKSGDSSDLPTIPALDIGAEECDLLAELKASHFKLLIKIHTNLTLKRPFD
```

FIGURE 3 (continued)

```
SEQID13  NEQIDGALVFSIEKLQEIQDELEKVNEEASDKVMEVEQKYSEIRRPVYLKRGDIIK----
SEQID19  NEQIDGVLVLSIEKLQEIQDELEKVNEEASDKVMEVEQKYSEIRRPVYLKRGDIIK----
SEQID17  NEQIDGALVLSIEKLQEIQDELEKVNEEASDKVLEVEQKYSEIRRPVYLRRSDVIQ----
SEQID15  -EPVDAALLQSIEKLQEIQDEIEKVNEEACDKVLELEQKYNEVRRPVYVRRNKIIK----
SEQID9   NNVIDEKLIFSIEKLQEIQDELEKINEKASDEVLEVEQKYNEIRKPVYDKRNDVIS----
SEQID23  -SYIDEKLIFSIEKLQEIQDDLDKINEKASEEVLEIEQKYNKIRKPVYDKRNDIIN----
SEQID7   -NTIDGELVFSIEKLQEIQDELEKINEEASDKVLEVEQKYNEIRKPVYDKRNDIIK----
SEQID2   LEQIDAELVLSIEKLQEIQDDLEKINEKASDEVLEVEQKYNVIRKPVYDKRNEVIQ----
SEQID21  VEQIDAELVLSIEKLQEIQDDLEKINEKASDEVLEVEQKYNVIRKPVYDKRNEIIK----
SEQID11  AEEIDGELVLSIEKLQEIQDEIEKINEEASDKVLEIEQKYNEVRKPVYDKRNDVIK----
SEQID25  LENLTPNVRKRVDALRDIQSQHDELEAKFREERAILEAKYQTLYQPLYVKRYEIVNGTTE
SEQID29  LENLTPKIRRRVEVLREIQGKHDEIETKFREERAALEAKYQKLYQPLYNKRYEIVNGATE
SEQID27  LENLTPPVRKRVEFLREIQNQYDEMEAKFFEERAALEAKYQKLYQPLYTKRYEIVNGVVE
SEQID36  LESLSPVVRKRVEVLREIQGEHDELEAKFLEERAALEAKYQILYQPLYTKRYDIVNGVAE
SEQID38  LETLSPNVRKRVESLREIQGKHDELEADFLKEREALEAKYQKLYQPLYTKRYEIVNGVTE
SEQID31  VKKLSPKVTKRVLFLKDIQVTHDELEEKFLAEKSALEATYDNLYKPLFAKRYEIVNGVVE
              . *  :: . ..*     :* . . :      *      * .:
```

```
SEQID13  ----------------------------------------TIPDFWLTAFLSHPLLSELLTEEDQKIFKYLDSIDVDD
SEQID19  ----------------------------------------TIPDFWLTAFMSHPLLSELLTEEDQKIFKYLDSIDVDD
SEQID17  ----------------------------------------TIPDFWLTAFLSHPLLSELLTEEDQKMFKYLESVDVDD
SEQID15  ----------------------------------------QIPDFWLTAFLSHPMLGELLTEDDQKIFKHLESIDVDD
SEQID9   ----------------------------------------SISDFWLTAFLSHPVLGNLLTEEDQKIFKFVSSIEVED
SEQID23  ----------------------------------------SISDFWLTAFLSHPVLGDLLTEEDQKIFKFLSSIEVED
SEQID7   ----------------------------------------AIPDFWLTAFLSHPVLGELLTEEDQKIFKFLSSIEVED
SEQID2   ----------------------------------------SIPGFWMTAFLSHPALGDLLTEEDQKIFKYLNSLEVED
SEQID21  ----------------------------------------TIPDFWLTAFLSHPALGELLTEEDQKIFKYLSSLDVED
SEQID11  ----------------------------------------SIPDFWLTAFLSHPVLGDLLNEEDQKIFKHLISLEVED
SEQID25  VELAPEDDTKVDQGEEKTAEEKGVPSFWLTALKNNDVISEEVTERDEGALKYLKDIKWCK
SEQID29  VEGAP-EDAKMDQGDEKTAEEKGVPSFWLTALKNNDVISEEITERDEGALIYLKDIKWCK
SEQID27  VEGAA-EEVKSEQGEDKSAEEKGVPDFWLIALKNNEITAEEITERDEGALKYLKDIKWSR
SEQID36  VVGVR-VETAVAEED----KEKGVPSFWLNAMKNNDVGGEEITERDEGALKFLKDIKWTR
SEQID38  VEGAANESTDESEEN----KEKGVPSFWLNAMENNDVLAEEISERDEGALKFLKDIKWSR
SEQID31  AEAEK--------------EGVPNFWLIAMKTNEMLANEITERDEAALKYLKDIRSCR
                                                       :  :  :  *  ..  :   *   ..  *  ..
```

FIGURE 3 (continued)

| | | | |
|---|---|---|---|
| SEQID13 | S-DVKAGYSIYLNFSENPYFEDTKLTKTYSFVDDGT--- | ---TTIKASQIKWKDGMGPANGNG |
| SEQID19 | S-DVKAGYSIHLNFSENPYFEDTKLAKTYIFADDGT--- | ---TTIKASEIKWKEGMGPANGNG |
| SEQID17 | SKDVKSGYSITLTFSENPYFEDKELTKTYAFADDGT--- | ---TTINATSIKWKEGMEIANGN- |
| SEQID15 | SEDIKSGYSITLTFSPNPYFEDTKLTKTYSFSDDEA--- | ---VKVKATSIRWKKGMDIANDRA |
| SEQID9 | SKDVKSGHSITFNFKPNPYFENSKLSKTYTFLEDGP--- | ---TKITATTIKWKEGMGIPNGVA |
| SEQID23 | SKDVKFGYSITFNFKPNPFFENSKLSKTYTFLEDGP--- | ---TKITATPIKWKEGKGIPNGVA |
| SEQID7 | SKDVKSGYSITFNFNANPYFENTKLTKTYTFLEDGP--- | ---TKISATTIKWKEGMGIPNGFA |
| SEQID2 | AKDVKSGYSITFHFTSNPFFEDAKLTKTFTFLEEGT--- | TKITATPIKWKEGKGLPNGVN |
| SEQID21 | AKDVKSGYSITFSFNPNPFFEDGKLTKTFTFLEEGT--- | ---TKITATPIKWKEGKGLANGVN |
| SEQID11 | HKDVKSGYSITFSFNFDSNPFFEDSKLVKTFTFLEEGT--- | ---TKLTATPIKWKEGKGIPNGVI |
| SEQID25 | IEEP-KGFKLEFFFDTNPYFKNTVLTKSYHMIDEDEPLLEKAMGTEIDWYPGKCLTQKIL | |
| SEQID29 | IEEP-KGFKLEFFFDQNPYFKNTLLTKAYHMIDEDEPLLEKAIGTEIDWYPGKCLTQKIL | |
| SEQID27 | VEEP-KGFKLEFFFDQNPYFKNTVLTKTYHMIDEDEPILEKALGTEIEWYPGKCLTQKIL | |
| SEQID36 | IEEP-KGFKLEFFFDSNPYFSNSVLTKIYHMVDEDEPILEKAIGTEIQWLPGKCLTQKVL | |
| SEQID38 | IENP-KGFKLDFFFDTNPYFSNTVLTKTYHMIDEDEPILEKAIGTEIEWYPGKCLTQKVL | |
| SEQID31 | VEDTSRNFKLEFLFDSNLYFKNSVLSKTYHVNDEDGPVLEKVIGTDIEWFPGKCLTHKVV | |
| | .:       : *    .: .   *     *   :   . . .      *   * | |

FIGURE 3 (continued)

```
SEQID13  IN--KKGNK------------RPLVVESFFSWFSDTELK----------------SLADG
SEQID19  IN--KKGSK------------RPLVEESFFSWFGDTELK----------------SLADG
SEQID17  AK--KKGSK------------RPLVEESFFTWFTDTEHK----------------SLADG
SEQID15  YT--KKGDK------------RILIDESFFTWFNSEKNR----------------SFAHG
SEQID9   DK--KKGNK------------RSHAEESFFTWFSEVNQKGDV-----------DDDENEILDI
SEQID23  QE--KKGNK------------RSHAEESFFTWFSEVNKKDDS-----------DDDENEVLEI
SEQID7   HE--KKGNK------------RSHAEESFFTWFSEVNQK--------------DEDEDEALEI
SEQID2   HDD-KKGNK------------RALPEESFFTWFTDAQHK--------------EDAGDEI
SEQID21  HE--KNGNK------------RALPEESFFTWFSDAQHK--------------EDVEDEM
SEQID11  HE--KKGNK------------RAASDISFFTWFCDTEQK--------------DEMG--D
SEQID25  KKKPKKGSK---NTKPITKLEDCESFFNFFSPPEVPDEDEDIDEE-------RAEDLQNLME
SEQID29  KKKPKKGAK---NAKPITKTEDCESFFNFFNPPQVPDDDEDIDEE-------RAEELQNLME
SEQID27  KKKPKKGSK---NTKPITKTEDCESFFNFFSPPQVPDDDEDLDDD------MADELQGQME
SEQID36  KKKPKKGAK---NAKPITKTETCESFFNFFNPPEVPDEDEDIDED------MAEELQNQME
SEQID38  KKKPKKGSK---NAKPITKTESCESFFNFFKPPEVPEDDADIDED------LAEELQNQME
SEQID31  VKKKTKKGPKKVNNIPMTKTENCESFFNFFKPPEIPEIDEVDDYDDFDTIMTEELQNLMD
                 :            :    ..   *    ***.:.*     .      : . :
```

FIGURE 3 (continued)

| | | |
|---|---|---|
| SEQID13 | VQDEVAEIIKEDLWPNPLKYFNNEVEDEFEGDEEDDDDDDDNLDGDNDDGDQEN------ | |
| SEQID19 | VQDEVAEIIKEDLWPNPLKYFNNEVDDEFEGDEDDDLDGDDDEGDDLEN---------- | |
| SEQID17 | VQDEVAEIIKEDLWPNPLKYFNNEAEELGEDDDEEGSDADEGEEDEEEEN--------- | |
| SEQID15 | AMDEVADVIKEDLWPNPLKYFNNEFEELELLDDDEVSDDDDEEDDEDQGEGEEDGEE-- | |
| SEQID9 | QDDEVAEIIKDDLWPNPLNYFDHEPDEEDIEGDEGKDSGGSEE---EEEEDDEDEDE-- | |
| SEQID23 | QD-EVAEIIKDDLWPNPLTYFTNEPDEEDFEGDEGGDEGDSEDEGDEEEEDDEDEDDK- | |
| SEQID7 | QD-EVADIIKDDLWPNPLTYFNNEPDEEDFDGDEGKDSEGSEDEEEEEEDEDGDEE--- | |
| SEQID2 | HD--EVADIIKEDLWSNPLTYFNNDADEEDFDGDDDGDEEGEEDDDDEEEEDGEE---- | |
| SEQID21 | QDEQVADIIKEDLWPNPLTYFNNDADEEDFDGDDDGDEEEKEGSDEDDDEEDVGEE--- | |
| SEQID11 | IHDEIAEMIKDDLWPNPLNYFNSEDPDEAEEEDDEAGDAGKDDDSEDDDQEDDDDEE-- | |
| SEQID25 | QDYDIGSTIREKIIPRAVSWFTGEAMEAEDFEIDDDEEDIDEDEDE----EDEEDEEDD | |
| SEQID29 | QDYDIGSTIREKIIPHAVSWFTGEAIEGEEFEIDNDDEDIDEDEDEDEDEDEEEDD | |
| SEQID27 | HDYDIGSTIKEKIISHAVSWFTGEAVEADDLDIEDDDEIDEDDDEEDEEDDEEEDD | |
| SEQID36 | QDYDIGSTIRDKIIP---MSWFTGEAAQGEEFGDLDEDEDDDAEEDEEEDEDDDD | |
| SEQID38 | QDYDIGSTLRDKIIPHAVSWFTGEAAQGDEFEDLEDDEDEDEDEDEDEDDEE | |
| SEQID31 | QDYDIAVTIRDKLIPHAVSWFTGEALVDEDDSDDNDDDNDEKSD--------- | |

FIGURE 3 (continued)

```
SEQID13  ------------------------------------------------------------
SEQID19  ------------------------------------------------------------
SEQID17  ------------------------------------------------------------
SEQID15  -----------------------------N------------------------------
SEQID9   ------------------------------------------------------------
SEQID23  ------------------------------------------------------------
SEQID7   ------------------------------------------------------------
SEQID2   ------------------------------------------------------------
SEQID21  ------------------------------------------------------------
SEQID11  ------------------------------------------------------------
SEQID25  EE-------------------------SKTKKKPSIGNKKGGRSQIVGEGKQDERPPECKQQ
SEQID29  DDEDEEE--------------------SKTKKKPSVLHKKGGRPQVTDD-QQGERPPECKQQ
SEQID27  EDEEEEV--------------------EDDDEEEEADQGKKSKKKSSAGHKKAGRSQLAEG-QAGERPPECKQQ
SEQID36  EEEEETK--------------------TKKKSSASKKRIGIAQLGDGQQGERPPECKQQ
SEQID38  EDDTKTK--------------------KKKS-----GKAQAGDGD-GERPPECKQQ
SEQID31  ------------------------------------------------------------
```

FIGURE 3 (continued)

A
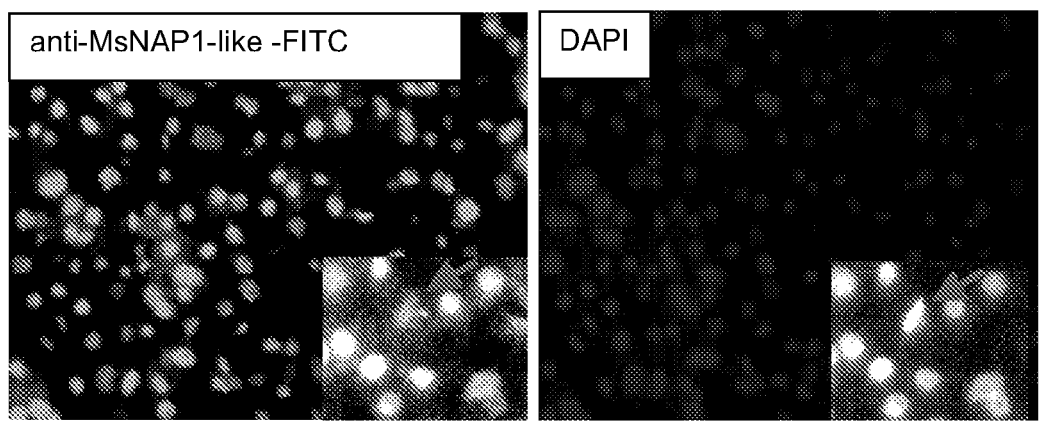
B
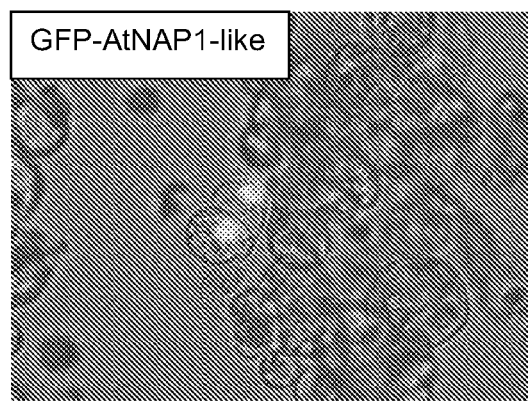
FIGURE 6

**SEQ ID NO: 1, coding sequence for *Arabidopsis thaliana* NAP1-like protein (AtNAP1), start and stop codon in bold**

GTGACGGAACCACAAGAAGAGAAGAGACCAAAAGGAGGAGCCAAAATCCTCTCTTTCTTTGGAATT
AGGGTTTCCTCAAAGGAAGTGAACTGAAAATGGTCGCGGACAAGAGCAAGAAGTCGAAAATTGAAG
AGAAAGGCGAAGAAGAAAACTTGGAGCAAATCGACGCAGAGCTTGTTCTCTCAATTGAAGCTTC
AGGAGATTCAAGACGACCTCGAGAAGATTAACGAAAAGGCCAGTGACGAGGTCTTGGAAGTAGAGC
AGAAATATAACGTGATACGGAAACCTGTCTATGACAAGCGCAATGAAGTTATCCAATCGATTCCTG
GCTTTTGGATGACTGCTTTTTTGAGTCATCCTGCCTTAGGCGACCTCTTGACTGAAGAAGACCAAA
AGATTTTTAAGTACTTGAACTCTCTGGAAGTGGAGGATGCCAAAGATGTGAAATCTGGATACTCTA
TAACTTTTCACTTCACTTCAAACCCGTTCTTTGAGGATGCCAAGCTTACCAAGACATTTACTTTCC
TTGAAGAAGGAACAACAAAAATCACTGCAACTCCTATCAAATGGAAGGAGGGCAAGGGCTTGCCAA
ATGGAGTGAACCATGATGATAAGAAAGGAAATAAACGTGCATTGCCAGAGGAGAGTTTCTTTACTT
GGTTTACTGATGCTCAACATAAGGAAGATGCTGGGGATGAGATTCATGATGAGGTTGCTGATATTA
TCAAGGAAGATCTCTGGTCCAACCCTCTCACCTACTTCAACAATGATGCTGATGAAGAGGATTTTG
ATGGAGATGATGATGGTGACGAAGAGGGAGAAGAAGACGATGACGATGAAGAGGAGGAAGATGGTG
AGGAATGATGGGAGCCCAAAGATAACACATTGCTGGCTTGCTTCTATAACAGATGTGTAAAGTTTG
TGTTATGAGGTTCTCAATTTTAGCAATGATGAGACTAAGCTTTCTCTTTTGGAATATTTAGTTTAT
TTACTATCAATAGCTACATTCTGTTTGTACGAACCATGTCATCATCCATGTCCTAAATCTTGCCAT
AACTACATCTGTTTTTCGC

**SEQ ID NO: 2, *Arabidopsis thaliana* NAP1-like (AtNAP1), deduced protein sequence**

MVADKSKKSKIEEKGEEENLEQIDAELVLSIEKLQEIQDDLEKINEKASDEVLEVEQKYNVIRKPV
YDKRNEVIQSIPGFWMTAFLSHPALGDLLTEEDQKIFKYLNSLEVEDAKDVKSGYSITFHFTSNPF
FEDAKLTKTFTFLEEGTTKITATPIKWKEGKGLPNGVNHDDKKGNKRALPEESFFTWFTDAQHKED
AGDEIHDEVADIIKEDLWSNPLTYFNNDADEEDFDGDDDGDEEGEEDDDDEEEEDGEE

**SEQ ID NO: 3, expression cassette (PRO0129::CDS0406 (*Arabidopsis thaliana* NAP1-like (AtNAP1a)) - T-zein - T-rbsc-deltaGA terminator; 1-2193: GOS2 promoter, 2246-3016: *NAP1-like* CDS, 3126-3320: T-Zein terminator, 3364-3560: T-rbs terminator**

AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAATACAAAAAATAATTTT
ACAGAATAGCATGAAAAGTATGAAACGAACTATTTAGGTTTTTCACATACAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG

FIGURE 8

GCTTTGCGGCCAGGAGAGAGGAGGAGAGGCAAAGAAAACCAAGCATCCTCCTTCTCCCATCTATAA
ATTCCTCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTCATTTAAATCAACTAGGGATATCACAAGTTTGTACAAAAAAGCAGGCTTCA
CAATGGTCGCGGACAAGAGCAAGAAGTCGAAAATTGAAGAGAAAGGCGAAGAAGAAAACTTGGAGC
AAATCGACGCAGAGCTTGTTCTCTCAATTGAGAAGCTTCAGGAGATTCAAGACGACCTCGAGAAGA
TTAACGAAAAGGCCAGTGACGAGGTCTTGGAAGTAGAGCAGAAATATAACGTGATACGGAAACCTG
TCTATGACAAGCGCAATGAAGTTATCCAATCGATTCCTGGCTTTTGGATGACTGCTTTTTTGAGTC
ATCCTGCCTTAGGCGACCTCTTGACTGAAGAAGACCAAAAGATTTTTAAGTACTTGAACTCTCTGG
AAGTGGAGGATGCCAAAGATGTGAAATCTGGATACTCTATAACTTTTCACTTCACTTCAAACCCGT
TCTTTGAGGATGCCAAGCTTACCAAGACATTTACTTTCCTTGAAGAAGGAACAACAAAAATCACTG
CAACTCCTATCAAATGGAAGGAGGGCAAGGGCTTGCCAAATGGAGTGAACCATGATGATAAGAAAG
GAAATAAACGTGCATTGCCAGAGGAGAGTTTCTTTACTTGGTTTACTGATGCTCAACATAAGGAAG
ATGCTGGGGATGAGATTCATGATGAGGTTGCTGATATTATCAAGGAAGATCTCTGGTCCAACCCTC
TCACCTACTTCAACAATGATGCTGATGAAGAGGATTTTGATGGAGATGATGATGGTGACGAAGAGG
GAGAAGAAGACGATGACGATGAAGAGGAGGAAGATGGTGAGGAATGATGGGACCCAGCTTTCTTGT
ACAAAGTGGTGATATCACAAGCCCGGGCGGTCTTCTAGGGATAACAGGGTAATTATATCCCTCTAG
ATCACAAGCCCGGGCGGTCTTCTACGATGATTGAGTAATAATGTGTCACGCATCACCATGGGTGGC
AGTGTCAGTGTGAGCAATGACCTGAATGAACAATTGAAATGAAAGAAAAAAGTACTCCATCTGT
TCCAAATTAAAATTCATTTTAACCTTTTAATAGGTTTATACAATAATTGATATATGTTTCTGTAT
ATGTCTAATTTGTTATCATCCGGGCGGTCTTCTAGGGATAACAGGGTAATTATATCCCTCTAGACA
ACACACAACAAATAAGAGAAAAAACAAATAATATTAATTTGAGAATGAACAAAAGGACCATATCAT
TCATTAACTCTTCTCCATCCATTTCCATTTCACAGTTCGATAGCGAAAACCGAATAAAAACACAG
TAAATTACAAGCACAACAAATGGTACAAGAAAACAGTTTTCCCAATGCCATAATACTCGAAC

SEQ ID NO: 4, Sense primer prm1505

GGGGACAAGTTTGTACAAAAAAGCAGGCTTCACAATGGTCGCGGACAAGAG

SEQ ID NO: 5, Reverse primer prm1506

GGGGACCACTTTGTACAAGAAAGCTGGGTCCCATCATTCCTCACCATC

FIGURE 8 (continued)

SEQ ID NO: 6, Nicotiana tabacum NAP1-like, start and stop codon in bold and underlined (NtNAP1a)

AGCGGCTGGTACCGGTCCGGAATTCCCGGGATATCGTCGACCCACGCGTCCGAAAGAAGAGAAAAA
GATGGGTGCTGACAAAGGGAAGAAGCAAAAAGTGGAGGAAGAGAACAACACCATTGATGGTGAGCT
CGTTTTTTCCATTGAAAAATTGCAAGAAATACAAGACGAGCTCGAGAAGATCAATGAGGAAGCAAG
TGATAAAGTATTGGAAGTGGAACAGAAGTACAATGAGATCCGCAAGCCTGTCTATGACAAACGAAA
CGACATCATTAAAGCTATCCCGGACTTCTGGTTGACTGCTTTTTTGAGTCATCCTGTCCTAGGTGA
ACTTCTAACTGAAGAAGACCAAAAGATCTTCAAGTTTCTAAGTTCTATTGAAGTTGAAGACTCTAA
AGATGTGAAGTCGGGCTACTCGATAACCTTTAACTTCAATGCGAATCCTTATTTTGAAAATACAAA
GCTCACAAAGACCTATACCTTCCTTGAAGATGGACCCACAAAGATTTCTGCTACAACAATAAAATG
GAAAGAAGGCATGGGCATTCCTAATGGATTTGCACATGAGAAGAAAGGAAACAAGCGATCTCATGC
TGAGGAAAGCTTCTTCACATGGTTCAGTGAAGTCAATCAAAAAGATGAGGATGAGGATGAGGCCCT
AGAGATTCAGGATGAGGTCGCTGACATAATTAAGGATGACTTGTGGCCGAACCCTCTCACCTATTT
TAACAACGAGCCTGATGAAGAAGATTTTGATGGTGACGAGGGAAAGGACAGTGAAGGCTCTGAAGA
CGAAGAGGAAGAAGAAGAGGAGGATGAGGATGGTGATGAAGAATGAAGGCAGTAAACTGTTCAAGA
CCCCTATTTTGGGATCTCGTCTTCAGCGGTTTTAATCATCAGGGTTTAATGTCTGTAAAGAGGCTT
TGAATGTTGCCAAAGAACAGAATAACTGTGGTGACTATACCTTTTCTTCTCTTGTATGGTTATAAC
TTATAAGCAAAATATCTAATTCCGGAGGTTCCAAAATGTTTTCATTAGGCTAGTTCGATTAATGAA
GTGTTTGTCTGGCAAAAACTGATAATGTTAGGTTATTGAGTTATG

SEQ ID NO: 7, Nicotiana tabacum NAP1-like (NtNAP1a), deduced protein sequence

MGADKGKKQKVEEENNTIDGELVFSIEKLQEIQDELEKINEEASDKVLEVEQKYNEIRKPVYDKRN
DIIKAIPDFWLTAFLSHPVLGELLTEEDQKIFKFLSSIEVEDSKDVKSGYSITFNFNANPYFENTK
LTKTYTFLEDGPTKISATTIKWKEGMGIPNGFAHEKKGNKRSHAEESFFTWFSEVNQKDEDEDEAL
EIQDEVADIIKDDLWPNPLTYFNNEPDEEDFDGDEGKDSEGSEDEEEEEEEDEDGDEE

SEQ ID NO: 8, Nicotiana tabacum NAP1-like, start and stop codon in bold and underlined (NtNAP1b)

TTTGTACAAAAAAGCAGGCTGGTACCGGTCCGGAATTCCCGGGATATCGTCGACCCACGCGTCCGA
GAAATTAGCAGTTAGAGACACTGAGAAGCAGCAGCTCTCTTCCTCAGCTGCTGTGTGCTTAGGCAA
AGAATAAAATGGGGGCAGACAAAGGGAAGAAGCAGAAAGTGGATGAGGAAAACAACAATGTTATTG
ATGAAAAGCTCATTTTTTCCATTGAAAAATTGCAAGAGATACAAGACGAGCTCGAGAAGATCAATG
AAAAAGCAAGCGACGAAGTGTTGGAAGTAGAACAGAAGTACAACGAGATCCGCAAGCCTGTCTACG
ATAAGCGAAATGATGTCATTAGCTCTATTTCTGACTTCTGGTTGACTGCTTTTTTGAGTCATCCTG
TTCTTGGTAACCTTCTCACTGAAGAGGACCAAAAGATTTTCAAATTTGTAAGTTCTATTGAAGTGG
AAGACTCAAAGGATGTGAAATCGGGTCATTCAATCACGTTTAACTTTAAGCCCAATCCTTATTTTG
AAAATTCAAAGCTCTCAAAGACGTATACCTTCCTTGAAGATGGACCTACAAAAATTACAGCTACAA
CAATAAAATGGAAAGAAGGCATGGGCATTCCTAATGGAGTTGCTGACAAGAAGAAAGGAAACAAGC
GGTCCCACGCTGAAGAAAGTTTCTTTACATGGTTCAGTGAAGTCAATCAAAAAGGTGATGTGGATG
ATGACGAAAATGAGATTCTGGACATTCAGGATGATGAGGTTGCTGAAATAATCAAGGATGACTTGT
GGCCTAACCCTCTCAATTATTTTGACCATGAGCCTGATGAAGAAGATATTGAGGGCGATGAGGGAA
AGGACAGCGGAGGCTCTGAAGAGGAAGAAGAAGAGGAAGATGATGAAGATGAAGAAGACGAATGAA
CTGTTGGTAGACCTTGTGTTTGATTTGAGTTCTCATCAGTGTTTCAATCATCAGAGTTGGTCTCTG
TAAAGAGGTTTCGGATATTGCAGAAAAATTGAATGACATATAGTGGTGACTCTAATTTTTAGTTTC
AGTGA

FIGURE 8 (continued)

SEQ ID NO: 9, Nicotiana tabacum NAP1-like (NtNAP1b), deduced protein sequence

MGADKGKKQKVDEENNNVIDEKLIFSIEKLQEIQDELEKINEKASDEVLEVEQKYNEIRKPVYDKR
NDVISSISDFWLTAFLSHPVLGNLLTEEDQKIFKFVSSIEVEDSKDVKSGHSITFNFKPNPYFENS
KLSKTYTFLEDGPTKITATTIKWKEGMGIPNGVADKKKGNKRSHAEESFFTWFSEVNQKGDVDDDE
NEILDIQDDEVAEIIKDDLWPNPLNYFDHEPDEEDIEGDEGKDSGGSEEEEEEEDDEDEEDE

SEQ ID NO: 10, Medicago sativa NAP1-like (Ms10.1), start and stop codon in bold and underlined

GGCACGAGCAAAACCCTAACACTTCCCTCATTCACGCTCGAAGAAAAGAACACAAATCTCTCCACT
GCGCTAGGGTTTGAAACCCAACACCTTCTGTTTCTTCAACCATGGTGGCCGACAAGTCTAAGAAGT
TGAAAGTTTCTGAAAAGGGTGAAAACGCTGAAGAGATCGACGGAGAACTTGTTCTCTCCATTGAAA
AGTTGCAGGAAATTCAAGATGAGATTGAAAAGATCAATGAGGAGGCTAGCGATAAAGTTCTCGAAA
TAGAGCAGAAGTACAATGAAGTAAGGAAACGGTGTATGACAAGCGCAATGATGTGATCAAGTCCA
TTCCCGATTTCTGGCTAACTGCGTTTTTGAGCCATCCTGTTCTTGGTGATCTCTTGAATGAAGAAG
ATCAGAAGATATTTAAGCATTTAATCTCTCTTGAGGTGGAAGATCATAAAGATGTTAAATCAGGCT
ATTCAATCACATTTAACTTCGACTCCAATCCCTTTTTTGAGGATTCAAAACTTGTTAAGACTTTTA
CCTTCCTTGAAGAAGGAACCACAAAGCTTACCGCCACACCCATAAAATGGAAAGAGGGCAAGGGCA
TTCCCAATGGAGTTATTCATGAAGAAAGGGAACAAGCGAGCTGCTTCTGATATCAGTTTCTTTA
CCTGGTTTTGTGACACTGAGCAGAAAGATGAAATGGGTGACATTCATGATGAGATTGCTGAAATGA
TCAAGGATGATTTATGGCCGAATCCACTCAATTATTTCAACAGTGAGGACCCTGATGAAGCAGAGG
AGGAGGATGATGAAGCTGGTGATGCGGGAAAGGATGATGATGACTCTGAAGATGATGATGATCAAG
AGGATGACGACGATGACGAGGAAGAAGAATAGTGTAAAATGCTTTAAAATAGTAATACTTGGTTTT
AATTTATTTATTTTAAGGTTATTATAGGAGTATCTTAGTGGTCTTTAGGGGATGATGAAAGACCAA
GGTTGGCTATTGGTTTTCCCCCTNTGGGCGTAAACCTTATTTATTGTGCTTTGAAGGTGATTTCTG
GTTTTATCTTTGTGCGCTTCTTTCAAGATACCAATGATACATCGGATTTTATCTTAGTCCTATATT
GAAACCATATAGTAGTTAAAATGTAGTATATTCAGTGTATAGCTGCGTAATCAGTATCATTTTATT
GCTATCACAACTTTACAGTACC

SEQ ID NO: 11, Medicago sativa NAP1-like (Ms10.1), deduced protein sequence

MVADKSKKLKVSEKGENAEEIDGELVLSIEKLQEIQDEIEKINEEASDKVLEIEQKYNEVRKPVYD
KRNDVIKSIPDFWLTAFLSHPVLGDLLNEEDQKIFKHLISLEVEDHKDVKSGYSITFNFDSNPFFE
DSKLVKTFTFLEEGTTKLTATPIKWKEGKGIPNGVIHEKKGNKRAASDISFFTWFCDTEQKDEMGD
IHDEIAEMIKDDLWPNPLNYFNSEDPDEAEEEDDEAGDAGKDDDDSEDDDDQEDDDDDEEEE

SEQ ID NO: 12, Zea mays nfa104 coding sequence (GenBank accession AF384036)

GTTCCTACCTTCTTCCCTCCGTCTCCCAGCTCGCGCAGGCAGGCGACACAGCGACGCTAAAAACCC
TAGAGCGAGGAGGCGTGCCAGGCCAGCGGTTTGCGATGACGGCACCGGCGGACAAGGGGAAGAAGG
CCAAGACCGATGCCGACGGCGGCGAGGAGAACGAGCAAATCGACGGCGCCCTTGTCTTCTCCATCG
AGAAGCTCCAGGAGATTCAGGACGAGCTCGAGAAGGTTAATGAGGAAGCAAGTGACAAGGTTATGG
AGGTGGAGCAGAAATACAGTGAGATTCGCAGACCTGTCTATCTCAAGAGGGTGACATTATCAAGA
CCATCCCGGACTTTTGGCTCACAGCGTTTTTGAGCCATCCTCTACTAAGTGAGCTTCTGACTGAAG

FIGURE 8 (continued)

AGGATCAGAAGATATTCAAGTACTTGGACTCCATTGATGTCGATGATTCTGATGTTAAGGCAGGAT
ATTCCATTTACCTTAACTTCTCTGAGAACCCGTACTTTGAAGACACAAAGCTTACAAAGACCTATT
CCTTTGTTGATGATGGAACAACCACAATAAAAGCTTCTCAAATTAAGTGGAAGGATGGAATGGGAC
CTGCAAATGGAAATGGTATTAACAAGAAGGGAAACAAGCGGCCATTAGTAGTGGAAAGTTTTTCT
CCTGGTTTAGTGATACAGAGCTCAAGAGTCTTGCTGATGGTGTGCAAGATGAGGTGGCGGAGATCA
TCAAGGAAGACTTGTGGCCTAATCCTTTGAAGTACTTCAACAATGAGGTTGAAGATGAATTTGAAG
GAGATGAAGAAGATGATGACGACGACGACGACGATGATAATTTGGATGGTGATGACAATGACGATG
ATGGGGACCAGGAGAACTGAGCCCTCGCGTTTAGGCGGGGAATTATGTG

SEQ ID NO: 13, Zea mays nfa104 deduced protein sequence (GenBank accession AAK67146)

MTAPADKGKKAKTDADGGEENEQIDGALVFSIEKLQEIQDELEKVNEEASDKVMEVEQKYSEIRRP
VYLKRGDIIKTIPDFWLTAFLSHPLLSELLTEEDQKIFKYLDSIDVDDSDVKAGYSIYLNFSENPY
FEDTKLTKTYSFVDDGTTTIKASQIKWKDGMGPANGNGINKKGNKRPLVVESFFSWFSDTELKSLA
DGVQDEVAEIIKEDLWPNPLKYFNNEVEDEFEGDEEDDDDDDDDNLDGDDNDDDGDQEN

SEQ ID NO: 14, Oryza sativa NAP1-like (OsNAP1a), coding sequence (GenBank accession XM_472746)

ATGGCGGCGGCGGAGCAGAAGGGGAAGAAGCCGAGGACCGACGGCGCGGAGGCCGAGCCCGTCGAC
GCCGCCCTGCTGCAGTCCATCGAGAAGCTCCAGGAGATCCAGGACGAGATCGAGAAGGTTAATGAG
GAAGCATGTGATAAAGTTCTGGAGTTGGAACAGAAATACAACGAGGTTCGCAGACCAGTTTATGTT
CGACGGAATAAAATTATCAAGCAAATTCCTGACTTCTGGCTGACAGCGTTTCTTAGCCATCCTATG
CTTGGTGAACTATTAACTGAAGATGATCAAAAGATTTTCAAACACTTGGAGTCTATCGACGTGGAT
GACTCAGAAGATATCAAATCAGGCTACTCCATTACTCTCACATTCTCCCCCAATCCATATTTTGAA
GATACAAAGCTTACAAAAACATATTCCTTTAGTGACGATGAAGCAGTCAAAGTAAAGGCTACCTCC
ATCAGGTGGAAGAAAGGAATGGATATTGCCAATGATCGTGCGTACACGAAGAAAGGGGACAAGCGA
ATCTTAATTGATGAAAGTTTCTTTACTTGGTTCAATAGTGAAAAGAACAGAAGTTTTGCTCATGGA
GCTATGGATGAGGTGGCAGATGTCATCAAGGAAGATCTGTGGCCTAATCCTTTGAAGTACTTCAAC
AATGAATTTGAAGAAGAATTAGAGCTACTGGATGACGATGACGAGGTATCTGATGATGACGATGAG
GAGGAGGATGATGAAGACCAAGGTGAAGGAGAGGAGGATGGAGAGGAGAACTGA

SEQ ID NO: 15, Oryza sativa NAP1-like (OsNAP1a), deduced protein sequence (GenBank accession XP_472746)

MAAAEQKGKKPRTDGAEAEPVDAALLQSIEKLQEIQDEIEKVNEEACDKVLELEQKYNEVRRPVYV
RRNKIIKQIPDFWLTAFLSHPMLGELLTEDDQKIFKHLESIDVDDSEDIKSGYSITLTFSPNPYFE
DTKLTKTYSFSDDEAVKVKATSIRWKKGMDIANDRAYTKKGDKRILIDESFFTWFNSEKNRSFAHG
AMDEVADVIKEDLWPNPLKYFNNEFEEELELLDDDDEVSDDDDEEEDDEDQGEGEEDGEEN

SEQ ID NO: 16, Oryza sativa NAP1-like (OsNAP1b) coding sequence (GenBank accession XM_506840)

CTCCGCTCTCCTCCAGCTCCGCCTCCGACGCGCGCACGCCTCTCCCTCCCCTCCTCCTCCGCCTCG
CCTCGCAGTGTGGAAGAAAGGAAGGAAGGCTAAAACCCTAGCGAGCGCGCGAGCGAGCGAGGGCTC
TCTGCTTCCTTGCGATGACGGCGCCGGCGGACAAGGGGAAGAAGGCCAAGACCGACGCCGACGGCG
GCGCCGCCGAGGAGAACGAGCAGATCGACGGCGCCCTCGTCCTCTCCATCGAGAAGCTCCAGGAGA

FIGURE 8 (continued)

```
TCCAGGACGAGCTCGAGAAGGTCAATGAGGAAGCTAGTGACAAGGTTTTGGAGGTCGAGCAGAAAT
ACAGTGAGATTCGCAGACCTGTCTATCTCCAAGGAGTGACGTTATCCAAACAATCCCCGACTTCT
GGCTGACAGCGTTTCTGAGTCATCCTCTACTTAGTGAGCTTTTGACCGAAGAGGATCAAAAGATGT
TCAAGTACCTGGAGTCTGTCGACGTGGATGATTCTAAAGATGTCAAGTCAGGCTACTCCATAACTC
TTACCTTCTCCGAGAACCCGTACTTTGAAGACAAAGAGCTCACGAAGACATATGCCTTCGCTGATG
ACGGAACAACCACAATAAATGCTACTAGCATTAAGTGGAAAGAAGGAATGGAAATTGCAAATGGGA
ATGCCAAGAAGAAAGGGAGCAAGCGACCATTGGTTGAGGAAAGTTTCTTCACCTGGTTTACTGATA
CAGAGCACAAGAGTCTTGCTGATGGTGTGCAAGATGAGGTGGCTGAGATCATCAAGGAAGACCTGT
GGCCCAATCCATTGAAGTATTTCAATAATGAGGCTGAAGAGTTAGGAGAGGATGACGACGAAGAGG
GGTCTGATGCTGATGAGGGTGAAGAGGATGAGGAGGAGGAGAACTGAGTCTAGGATGTCAGATTGC
GATGGTGCCGATCGTCTGCATTTTGTGGATGCTGTCACTCTGAAGGGCGAAGTTGCGTGACCCTCG
GTTGCTTCTTTCTTTTTTCTTTTTGATGACTTAGCTGGAACCCTTAGGAACTGTTTAATGCCTTAT
GGAGTCCGTCGTATTTTCGACTCAAAGGAGACACCTCTATATCATAATCTGCGTATAACCATGGAA
GACATTTTAACCTGCTGATGTGTGGTTCATTGCGCTGCCTCTGGTGCTGTAGGGTGTTCGTTCCTT
TGTGCTCTCTGTCTTTTTTTTTTTTTTGTGTGTGTGTGGTCGCGCTGGCATTGTTGCCAGTCTG
ATGGGCTGTTATTCTCCCCCTAGAAAGAGTGAAAAACCTGGCTTGTGATCATTGTTTACG
```

SEQ ID NO: 17, Oryza sativa NAP1-like (OsNAP1b), deduced protein sequence (GenBank accession XP_506840)

```
MTAPADKGKKAKTDADGGAAEENEQIDGALVLSIEKLQEIQDELEKVNEEASDKVLEVEQKYSEIR
RPVYLRRSDVIQTIPDFWLTAFLSHPLLSELLTEEDQKMFKYLESVDVDDSKDVKSGYSITLTFSE
NPYFEDKELTKTYAFADDGTTTINATSIKWKEGMEIANGNAKKKGSKRPLVEESFFTWFTDTEHKS
LADGVQDEVAEIIKEDLWPNPLKYFNNEAEELGEDDDEEGSDADEGEEDEEEEN
```

SEQ ID NO: 18, Zea mays nfa103 coding sequence (GenBank accession AF384035)

```
CCAAAAGGGTCACAGTTCCGCCTCCTTTTCCTGCCTTCCTCCTCACTAGTCGCTCCCCCGCGGCTC
GCGCAGGCGGGCGACACAACGAGGCTAAATCCCTATCGCGAGGAGGCGTGTGAGGCCAGCGGCTTT
GCGATGACAGCACCAGCGGACAAGGGGAAGAAGGCCAAGACTGATGCCGACGGCGGCGAGGAGAAC
GAACAGATCGACGGCGTCCTCGTCCTCTCCATCGAGAAGCTCCAGGAGATACAGGACGAGCTCGAG
AAGGTAAATGAGGAAGCAAGTGACAAGGTTATGGAGGTGGAGCAGAAATACAGTGAGATCCGCAGA
CCTGTCTATCTCAAGAGGGGTGACATTATCAAGACCATCCCGGACTTTTGGCTCACAGCGTTTATG
AGCCATCCTCTATTAAGTGAGCTTCTGACTGAAGAGGACCAGAAGATATTCAAGTACTTAGACTCC
ATTGATGTGGATGATTCTGATGTTAAGGCAGGATACTCCATTCATCTTAACTTCTCTGAGAACCCG
TACTTTGAGGACACAAAGCTTGCAAAGACCTATATCTTTGCTGATGATGGAACAACCACAATAAAA
GCTTCCGAAATTAAGTGGAAGGAAGGAATGGGACCTGCAAATGGAAATGGTATTAACAAGAAGGGG
AGTAAGCGGCCATTAGTAGAGGAAAGTTTTTTTAGCTGGTTTGGTGATACAGAGCTCAAGAGTCTT
GCTGATGGTGTGCAAGATGAGGTGGCGGAGATCATAAAGGAAGATTTGTGGCCTAATCCTTTGAAG
TACTTCAACAATGAGGTTGACGATGAATTTGAAGGAGATGAAGATGATGATGATTTGGATGGTGAT
GATGACGATGAAGGCGATGATTTGGAGAACTGAGCCCTTGCGCTTGGTTCAGAATGTTGTCCGTGG
ATGATGTGGCTGGGCGGAACTGTGACCCTTTTGG
```

FIGURE 8 (continued)

SEQ ID NO: 19, Zea mays nfa103 deduced protein sequence (GenBank accession AAK67145)

MTAPADKGKKAKTDADGGEENEQIDGVLVLSIEKLQEIQDELEKVNEEASDKVMEVEQKYSEIRRP
VYLKRGDIIKTIPDFWLTAFMSHPLLSELLTEEDQKIFKYLDSIDVDDSDVKAGYSIHLNFSENPY
FEDTKLAKTYIFADDGTTTIKASEIKWKEGMGPANGNGINKKGSKRPLVEESFFSWFGDTELKSLA
DGVQDEVAEIIKEDLWPNPLKYFNNEVDDEFEGDEDDDDLDG
DDDDEGDDLEN

SEQ ID NO: 20, coding sequence for *Arabidopsis thaliana* NAP1-like protein (GenBank accession NM_101738)

AGATTCACGCATCACACAATCGAGTTTTTAGGGTTTTAGCGGTTGCTCTCTCGGAAGCCAGAGAGA
AGAGGGAAGAGGAAGTCTAATTCCTCTGCGTTTTTGCAATTAGGGTTTTCTCAATTGGAATCGAA
AATGGTGACAGACAAGAGCAAGAAGGCGAAAACCGAAGAAGAAACGTCGAGCAAATCGATGCAGA
GCTTGTCCTCTCAATCGAAAAGCTTCAAGAGATCCAAGACGACCTCGAGAAGATAAATGAAAAGGC
TAGTGATGAAGTGTTGGAAGTGGAGCAGAAATATAATGTGATAAGGAAACCTGTTTATGACAAGCG
TAACGAGATCATCAAACCATCCCTGATTTCTGGTTAACTGCTTTCTTGAGTCACCCTGCTTTAGG
TGAACTTTTGACTGAAGAAGACCAAAAGATTTTCAAATATCTTAGCTCTCTTGATGTTGAGGATGC
CAAAGATGTGAAATCTGGATACTCTATCACTTTTTCCTTCAATCCCAATCCATTTTTTGAAGATGG
AAAACTGACAAAGACTTTTACCTTTCTCGAAGAAGGGACAACCAAAATCACAGCCACGCCTATCAA
ATGGAAAGAGGGCAAAGGCCTGGCGAATGGAGTGAATCATGAGAAGAATGGAAACAAACGTGCACT
ACCTGAAGAGAGCTTCTTTACCTGGTTTAGTGATGCTCAACACAAGGAGGATGTTGAGGATGAGAT
GCAAGACGAGCAGGTTGCAGATATCATCAAGGAAGATTTGTGGCCCAACCCTCTCACCTACTTCAA
CAATGACGCTGATGAAGAGGACTTTGATGGAGACGATGATGGAGATGAAGAGGAGAAAGAAGGTGA
CTCTGATGAAGATGATGACGAAGAAGACGAAGTTGGTGAGGAATGATGGCAGGGATACCCAGAAAC
CACATTTGCTTACATGTCTTCTCTATAACAGAGTGTGTAAAGTTTTGTGTGTTGAAAGGTTTTTAA
TTTTAAGCAAAAGTGGATTATGACGACAACAGACAAGCTTTTAATTTTATTTTACCGTAATAGTTA
TATCTTGTTGTAAGAAACCATTTTCAGCCTTTTGTTGGAAAATCCTGCTTAAATGGTTTTTGAGTC
TTACATAATAGCTTCTTCATCTTTTGTCTTCTTAAAGAGAATTATATTTGTAATTTCATGTCTGTT
GTGTTTCTTTGACTTTACTGAATAGAGAATTTGTGTGTTTATGGTGAAAATATAGCCGATCTGCTT
GAC

SEQ ID NO: 21, *Arabidopsis thaliana* NAP1-like, deduced protein sequence (GenBank accession NP_564063)

MVTDKSKKAKTEEENVEQIDAELVLSIEKLQEIQDDLEKINEKASDEVLEVEQKYNVIRKPVYDKR
NEIIKTIPDFWLTAFLSHPALGELLTEEDQKIFKYLSSLDVEDAKDVKSGYSITFSFNPNPFFEDG
KLTKTFTFLEEGTTKITATPIKWKEGKGLANGVNHEKNGNKRALPEESFFTWFSDAQHKEDVEDEM
QDEQVADIIKEDLWPNPLTYFNNDADEEDFDGDDDGDEEEKEGDSDEDDDEEDEVGEE

SEQ ID NO: 22, Lycopersicon esculentum NAP1-like coding sequence protein (LeNAP1, GenBank accession BT013059)

GCGAAATCAAGAAAATCAGTTAAGCAGCTCTGTAACTCAGGTGGGAAAAAGGCAAAAAATAATGGT
GGTTGACAAAGGGAAGAAGCAGAAGTGGAAGAGGAAAGCTACATTGATGAAAAGCTCATTTTTTC
CATTGAAAAATTGCAAGAAATACAAGACGACCTTGACAAGATCAATGAGAAGCAAGTGAGGAAGT
GTTGGAAATAGAACAGAAGTACAACAAGATCCGCAAGCCTGTTTATGATAAGCGGAATGATATCAT

FIGURE 8 (continued)

```
TAACTCTATTTCTGACTTCTGGTTGACTGCTTTTTTGAGTCATCCTGTTCTTGGTGACCTTCTAAC
TGAAGAGGACCAAAAGATTTTCAAATTCTTAAGTTCTATTGAAGTGGAAGACTCGAAAGATGTGAA
ATTTGGTTACTCAATCACGTTTAACTTTAAGCCCAATCCTTTCTTTGAAAATTCAAAGCTCTCAAA
GACCTATACCTTCCTTGAAGATGGACCTACAAAATCACAGCTACACCAATAAAATGGAAAGAAGG
CAAAGGCATTCCTAATGGCGTTGCTCAGGAGAAGAAAGGAAACAAGCGATCCCATGCTGAAGAGAG
CTTCTTCACCTGGTTCAGTGAAGTCAATAAAAAAGATGATAGCGATGATGATGAAAATGAGGTTCT
GGAGATTCAGGATGAGGTTGCTGAAATAATCAAGGATGACTTGTGGCCAAACCCTTTAACTTATTT
TACCAATGAACCTGATGAAGAAGATTTTGAGGGTGATGAAGGTGGTGATGAGGGGGAGGACTCTGA
AGATGAAGGTGATGAGGAGGAAGAGGAAGACGACGAAGATGAAGATGACAAATGAACTGTTAATGG
ACCTCATATTTGATTTGATTTCTCTTCTTCAATGTTTCAATTATCATAGTTGGTATCTGTAAAGAA
GCTTAATATTGCAGATAAAATCGAATTATATATAGTGGTGACTGCTTTTTTTCTAAAAAAAAAAA
AAAAAAAAAAAAA

SEQ ID NO: 23, Lycopersicon esculentum NAP1-like deduced protein
sequence (LeNAP1)

MVVDKGKKQKVEEESYIDEKLIFSIEKLQEIQDDLDKINEKASEEVLEIEQKYNKIRKPVYDKRND
IINSISDFWLTAFLSHPVLGDLLTEEDQKIFKFLSSIEVEDSKDVKFGYSITFNFKPNPFFENSKL
SKTYTFLEDGPTKITATPIKWKEGKGIPNGVAQEKKGNKRSHAEESFFTWFSEVNKKDDSDDDENE
VLEIQDEVAEIIKDDLWPNPLTYFTNEPDEEDFEGDEGGDEGEDSEDEGDEEEEEDDEDEDDK

SEQ ID NO: 24, coding sequence for Arabidopsis thaliana NAP1-like
protein (GenBank accession NM_118744)

GTCCCTAGTCTCTTCTGCTTCTTCTTCTTCAAAATCTCTCTCTTCACCAAATCCTCAGAAGATGAG
CAACGACAAGGATAGCTTCAACGTCTCCGATCTTACTGCTGCTCTTAAGGACGAGGATCGAGCTGG
CCTTGTCAATGCTCTAAAGAACAAGCTGCAGAATCGGCTGGTCAGCGTTCTGATGTGCTCGAGAA
TCTGACTCCCAATGTGAGAAAGCGCGTTGATGCCTTGAGGGATATACAGAGCCAACATGATGAACT
AGAGGCAAAATTCCGTGAGGAGAGAGCTATTCTTGAAGCCAAGTATCAAACGCTGTATCAGCCTTT
GTATGTCAAGCGTTATGAGATTGTGAATGGCACTACTGAAGTTGAACTGGCTCCAGAGGATGATAC
CAAGGTGGACCAAGGAGAGGAGAAAACTGCAGAAGAGAAAGGAGTTCCAAGTTTCTGGCTGACAGC
TCTGAAAATAACGATGTTATTTCCGAGGAGGTCACAGAGCGTGATGAAGGGGCTCTCAAATATCT
TAAAGATATTAAGTGGTGCAAGATTGAAGAGCCTAAAGGATTCAAACTTGAGTTTTTCTTTGACAC
GAATCCGTATTTTAAGAACACTGTCTTGACAAAGTCTTATCATATGATTGATGAAGATGAGCCACT
GCTTGAGAAGGCTATGGGACAGAAATTGATTGGTATCCTGGAAAGTGTCTAACTCAGAAGATTCT
CAAGAAGAAGCCTAAGAAAGGTTCAAAGAATACTAAACCAATCACCAAACTCGAAGATTGTGAAAG
CTTCTTCAACTTCTTTAGTCCTCCAGAAGTTCCGGATGAAGATGAAGATATCGACGAGGAAAGAGC
TGAGGATCTTCAAAACCTGATGGAACAAGATTATGACATCGGATCTACTATTCGGGAAAAGATTAT
TCCTCGTGCTGTCTCATGGTTTACTGGTGAGGCTATGGAAGCAGAGGATTTTGAAATAGATGACGA
TGAGGAAGATGACATTGATGAGGATGAAGATGAGGAAGACGAAGAGGATGAGGAGGACGATGATGA
TGAGGATGAAGAAGAAAGCAAGACCAAAAAGAAGCCATCAATCGGCAACAAGAAGGGAGGGAGATC
TCAGATAGTTGGTGAAGGTAAACAAGATGAGAGGCCACCCGAATGCAAGCAACAGTAATCTTTTAC
TACGCTCTACCAGACATAAAAGGATTGCGTGAAATATAATTCAGGTCATTCTCTGTTCATCAAGA
ATGAGGATTGAGAAAGGTTTTGGGATTTTAAAAGTGAAATTCATCTTGTAGGAGTTTCGTTCGT
TTTTCTATTGGTGTGTTTATTTTCTCTAAAGCACTTTAATAATATACCTTGGTATTTAATTTATGA
ATCAAGCATCATCATCCCTAGTCTCTGCATTCACTACTTCATCCCCTACCTAAACTTTGTCGACGA
AAGAGATTTTAATAACCATTTAGATAGTAATGGGTAGTGGGAATGATCATTATTCTTTTGTTCACC
GTCCTTTGATTTTCAATGGTAACCATTTTGTTGTGTAAG
```

SEQ ID NO: 25, *Arabidopsis thaliana* NAP1-like, deduced protein sequence (GenBank accession NP_194341)

MSNDKDSFNVSDLTAALKDEDRAGLVNALKNKLQNLAGQRSDVLENLTPNVRKRVDALRDIQSQHD
ELEAKFREERAILEAKYQTLYQPLYVKRYEIVNGTTEVELAPEDDTKVDQGEEKTAEEKGVPSFWL
TALKNNDVISEEVTERDEGALKYLKDIKWCKIEEPKGFKLEFFFDTNPYFKNTVLTKSYHMIDEDE
PLLEKAMGTEIDWYPGKCLTQKILKKKPKKGSKNTKPITKLEDCESFFNFFSPPEVPDEDEDIDEE
RAEDLQNLMEQDYDIGSTIREKIIPRAVSWFTGEAMEAEDFEIDDDEEDDIDEDEDEEDEEDEEDD
DDEDEEESKTKKKPSIGNKKGGRSQIVGEGKQDERPPECKQQ

SEQ ID NO: 26, coding sequence for *Arabidopsis thaliana* NAP1-like protein (GenBank accession NM_127506)

GTGTCTTATTTCGGTCTGGTCATTTTCTCAAAGCCCTTTTAGTTATTTATATATATATTCTCTGTC
TCGTATTTGTCCCCAAAAATCTAGGGTTTTAAGGTTTCTTATCCTTCCTCTTCCTCCGCCAGATTC
TTTTCTTGCGAAGATGAGCAACGACAAGGACAGCATGAACATGTCCGATCTCTCCACCGCTCTTAA
CGAGGAGGATCGTGCCGGGCTTGTTAATGCTCTTAAGAACAAGTTGCAGAATTTGGCTGGACAACA
CTCTGATGTCCTTGAAAACTTGACTCCACCAGTCAGGAAGCGTGTCGAGTTTCTAAGAGAGATTCA
GAACCAATATGATGAGATGGAAGCAAAATTCTTTGAGGAGAGAGCAGCTCTTGAAGCTAAGTATCA
AAAGTTATATCAGCCTTTATATACCAAGCGATATGAGATTGTGAATGGTGTGGTCGAAGTTGAAGG
TGCAGCTGAAGAAGTAAAATCCGAACAAGGAGAAGATAAATCAGCTGAAGAGAAAGGAGTACCAGA
TTTCTGGCTTATTGCATTGAAGAACAATGAAATTACTGCGGAAGAGATAACTGAGCGAGATGAAGG
GGCTCTCAAGTATCTCAAAGATATCAAGTGGAGTAGGGTTGAAGAACCAAAAGGGTTCAAGCTTGA
GTTTTTCTTTGATCAGAATCCTTACTTCAAGAACACTGTCTTGACCAAGACATATCACATGATTGA
TGAAGATGAGCCTATCCTTGAGAAGGCCCTCGGGACGGAGATTGAGTGGTATCCTGGAAAGTGTTT
GACACAGAAGATTCTAAAAAAGAAGCCAAAGAAAGGATCCAAAAACACAAAGCCGATCACTAAGAC
TGAGGACTGTGAGAGTTTCTTCAACTTTTTCAGTCCACCTCAAGTTCCTGACGATGATGAGGATCT
TGATGATGACATGGCTGATGAACTCCAAGGACAAATGGAGCATGATTATGATATCGGTTCAACAAT
CAAAGAGAAATCATCTCGCATGCTGTGTCATGGTTCACTGGTGAAGCTGTTGAGGCAGATGACCT
TGATATTGAGGACGACGATGATGAGATTGATGAAGATGATGATGAAGAGGACGAGGAAGATGATGA
GGATGACGAGGAGGAGGATGATGAGGATGATGACGAGGAGGAAGAAGCAGATCAAGGAAAGAAGAG
CAAAAAGAAGTCATCAGCTGGGCACAAGAAGGCTGGAAGAAGTCAACTTGCGGAAGGTCAAGCAGG
TGAGAGGCCACCGGAATGTAAGCAGCAGTGAAGAAGTGAAGAATCTTGGCTTAGTTATGATGAAGA
AGAAGAGTGAAGAGTGTCTTTGAGCCGAGGTTGTGTTTCTTTAATTTGCAGAGTCATGGTCCGGTT
TATTATATATCAGTTTTGGGTGATTGGTTTGCTATTTAAAAAAAAAAAATGGGTTCTTTGGTTTGG
TTTGTGTCTCTTGATTTTTCCTTTTGTAATGATCTTATGAATTTGTTTCGAGTTAATGTCGTTCTC
TGGTCAGATTTCGAATTCAATTCTATTTATCCTCCCTCGTTAATGAGAGAATTTGTG

SEQ ID NO: 27, *Arabidopsis thaliana* NAP1-like, deduced protein sequence (GenBank accession NP_179538)

MSNDKDSMNMSDLSTALNEEDRAGLVNALKNKLQNLAGQHSDVLENLTPPVRKRVEFLREIQNQYD
EMEAKFFEERAALEAKYQKLYQPLYTKRYEIVNGVVEVEGAAEEVKSEQGEDKSAEEKGVPDFWLI
ALKNNEITAEEITERDEGALKYLKDIKWSRVEEPKGFKLEFFFDQNPYFKNTVLTKTYHMIDEDEP
ILEKALGTEIEWYPGKCLTQKILKKKPKKGSKNTKPITKTEDCESFFNFFSPPQVPDDDEDLDDDM
ADELQGQMEHDYDIGSTIKEKIISHAVSWFTGEAVEADDLDIEDDDDEIDEDDDEEDEEDDEDDEE
EDDEDDDEEEEADQGKKSKKKSSAGHKKAGRSQLAEGQAGERPPECKQQ

FIGURE 8 (continued)

**SEQ ID NO:28, coding sequence for *Arabidopsis thaliana* NAP1-like protein (GenBank accession NM_125077)**

GCCACCCAGAAAAAACCCTCAAGTCTTCTTCTTCTTCCTCAATCTCTCCACCTCTTTTCAAACCTT
CTTCACACTCTCTCTCAATCAATCCTTTTTCTTCTCAAATCTTTCAGTTTTGATCTCTAAATTTCC
AGAAAATGAGCAACGATAAGGACAGTTTCAATGTCAGCGATCTCACTTCTGCTCTTAAAGATGAGG
ATCGAGCTGGTCTTGTCAACGCTCTTAAGAACAAGCTCCAGAATCTAGCTGGACAACATTCTGATG
TGCTCGAGAATCTGACTCCTAAAATTAGAAGGCGTGTTGAGGTTTTGCGGGAGATTCAGGGCAAAC
ATGATGAAATAGAGACAAAATTCCGCGAGGAGAGAGCTGCTCTTGAAGCCAAGTATCAAAAGTTAT
ATCAGCCTTTGTATAACAAGCGTTATGAGATTGTGAATGGAGCTACTGAAGTTGAAGGGCTCCAG
AGGATGCTAAGATGGACCAAGGAGACGAGAAAACTGCAGAAGAGAAAGGAGTCCCTAGTTTCTGGC
TGACTGCTCTGAAAAATAATGATGTTATATCTGAAGAGATCACAGAGCGTGATGAAGGAGCCCTTA
TATATCTTAAAGATATCAAGTGGTGCAAGATTGAAGAACCAAAGGGATTCAAACTTGAGTTTTTCT
TCGACCAGAATCCTTACTTCAAAAACACCCTATTAACAAAGGCGTATCATATGATTGATGAAGATG
AGCCTCTGCTTGAGAAGGCTATTGGGACAGAGATTGATTGGTATCCTGGAAAATGCTTAACTCAGA
AGATTCTTAAGAAGAAGCCTAAGAAAGGTGCAAAGAATGCCAAGCCAATTACCAAAACTGAAGATT
GTGAAAGCTTCTTCAACTTCTTCAATCCTCCCCAAGTTCCTGATGATGATGAAGACATTGACGAAG
AAAGAGCCGAGGAACTTCAGAATCTGATGGAACAAGATTATGACATTGGTTCTACAATCCGGGAGA
AGATCATACCTCATGCTGTCTCATGGTTTACTGGTGAGGCTATTGAGGGAGAGGAGTTTGAAATAG
ACAATGACGATGAAGATGATATCGATGAGGATGAAGATGAGGATGAAGAAGATGAAGACGAAGATG
AGGAAGAAGACGACGAAGATGAGGAGGAAGAAGTAAGCAAGACCAAAAAGAAGCCATCAGTCTTAC
ACAAGAAAGGAGGGAGACCTCAGGTTACCGATGATCAACAAGGAGAGAGGCCTCCTGAATGCAAAC
AACAGTAAACAAAATCGAAAAGTCTAAACGAAAACCAGTAAAAGAAAAACAAATGTTTTGGGTTTT
GAGTGAAGTTTCATGGCCTAGTTTTTTGCTTCCATGTAAGGCAAAATGTTTTGAAGACTGCTCATA
GGAATGTTGCTGTAGGCAAAAGAGTGAGTTTCTCCATGTGGAGATACTTGATAAATTATTTTTGGT
GCATTTGTTTTTTTTTTTTTAATCACTAAGTTGAATTTTGGTGTGTTCGTCAAAATTATATCTTT
TTACCACTTGAATTAAGTCTCTTTTGGTTTCTTTAATTTAAAAATAAATAAATCTTATCATTGTTT
TTTTTGTGTGGACATAAGTGTATTATTCTTATTGTAAACC

**SEQ ID NO: 29, *Arabidopsis thaliana* NAP1-like, deduced protein sequence (GenBank accession NP_568844)**

MSNDKDSFNVSDLTSALKDEDRAGLVNALKNKLQNLAGQHSDVLENLTPKIRRRVEVLREIQGKHD
EIETKFREERAALEAKYQKLYQPLYNKRYEIVNGATEVEGAPEDAKMDQGDEKTAEEKGVPSFWLT
ALKNNDVISEEITERDEGALIYLKDIKWCKIEEPKGFKLEFFFDQNPYFKNTLLTKAYHMIDEDEP
LLEKAIGTEIDWYPGKCLTQKILKKKPKKGAKNAKPITKTEDCESFFNFFNPPQVPDDDEDIDEER
AEELQNLMEQDYDIGSTIREKIIPHAVSWFTGEAIEGEEFEIDNDDEDDIDEDEDEDEEDEDEDEE
EDDEDEEEVSKTKKKPSVLHKKGGRPQVTDDQQGERPPECKQQ

**SEQ ID NO: 30, coding sequence for *Arabidopsis thaliana* NAP1-like protein (GenBank accession NM_112230)**

ATGAGCAACGAAGAAACATCAAATCTGATAATAAGAGCGGCGATTCCTCTGATCTCCCTACCATT
CCCGCCTTAGATATTGGGGCAGAGGAATGTGATCTTCTTGCAGAGCTTAAGGCAAGTCACTTCAAA
TTGTTGATAAAAATTCACACAAACCTAACCTTAAAGCGACCATTTGATGTGAAAAAACTCTCACCT
AAAGTTACCAAACGTGTTCTGTTCCTCAAAGACATTCAGGTTACACACGATGAACTCGAAGAGAAG
TTTCTTGCTGAGAAATCTGCATTGGAGGCAACATATGATAATCTCTACAAGCCGCTTTTTGCTAAG
AGGTATGAAATTGTGAATGGTGTGGTCGAAGCTGAAGCAGAGAAGAAGGAGTTCCCAATTTCTGG

FIGURE 8 (continued)

```
TTGATTGCAATGAAAACCAATGAAATGCTCGCAAATGAGATAACGGAAAGAGATGAGGCAGCATTG
AAGTATCTTAAGGACATCAGATCTTGCAGAGTTGAAGACACTTCAAGAAATTTCAAGCTGGAGTTT
CTCTTTGATTCTAATCTTTACTTCAAGAACTCGGTTCTGTCTAAAACTTACCATGTGAACGATGAA
GATGGTCCTGTTCTTGAGAAAGTGATTGGAACGGACATAGAATGGTTTCCAGGTAAATGTTTGACT
CATAAGGTTGTTGTGAAGAAGAAAACAAAGAAAGGGCCAAAGAAGGTCAACAACATCCCCATGACC
AAAACAGAAAACTGCGAGAGTTTCTTCAATTTCTTCAAGCCACCTGAGATTCCTGAGATTGATGAA
GTTGACGATTACGATGATTTTGATACCATTATGACGGAAGAACTACAAAACCTGATGGACCAAGAC
TATGACATTGCTGTGACAATCCGAGATAAACTGATCCCTCATGCAGTTTCATGGTTTACGGGAGAG
GCTCTTGTTGATGAAGACGATTCTGATGATAATGATGATGATGATAATGATGAGAAGAGTGACTAA
```

**SEQ ID NO: 31, *Arabidopsis thaliana* NAP1-like, deduced protein sequence (GenBank accession NP_187993)**

```
MSNEENIKSDNKSGDSSDLPTIPALDIGAEECDLLAELKASHFKLLIKIHTNLTLKRPFDVKKLSP
KVTKRVLFLKDIQVTHDELEEKFLAEKSALEATYDNLYKPLFAKRYEIVNGVVEAEAEKEGVPNFW
LIAMKTNEMLANEITERDEAALKYLKDIRSCRVEDTSRNFKLEFLFDSNLYFKNSVLSKTYHVNDE
DGPVLEKVIGTDIEWFPGKCLTHKVVVKKKTKKGPKKVNNIPMTKTENCESFFNFFKPPEIPEIDE
VDDYDDFDTIMTEELQNLMDQDYDIAVTIRDKLIPHAVSWFTGEALVDEDDSDDNDDDDNDEKSD
```

SEQ ID NO: 32, NAP domain of the protein sequence encoded by at1g74560 (SEQ ID NO: 2), the signature is indicated in italics

```
IEKLQEIQDDLEKINEKASDEVLEVEQKYNVIRKPVYDKRNEVIQSIPGFWMTAFLSHPALGDLLT
EEDQKIFKYLNSLEVEDAKDVKSGYSITFHFTSNPFFEDAKLTKTFTFLEEGTTKITATPIKWKEG
KGLPNGVNHDDKKGNKRALPEE*SFFTWF*TDAQHKEDAGDEIHDEVADIIKEDLWSNPLTYFNNDAD
E
```

SEQ ID NO: 33

(T/S)FF(T/N/S/E/D)(W/F)(L/F)

SEQ ID NO: 34

SIEKLQEIQD

**SEQ ID NO: 35, U81289.1|PSU81289 *Pisum sativum* NAP1Ps mRNA, complete cds**

```
GGCACGAGGATTAGAGAGCCAGTTCCAGACAGTACAATCAATCAAAACCCTCCCCTTCTTCCGGCT
AGGTTTTGCTTTTTTGCTGTCATCTTCTTCTTCCTCCATTTCTCACTTCTCAATGACGAACAACAA
GGAAGCTTTCAACATCTCAGATCTCAGTTCCGCTCTCAATGAAGAGGATCGGGCTGACCTGGTCAA
CGCTCTCAAGAGTAAGATACAGAGTCTTGCTGGGCAACACTCTGATGTTCTGGAGAGTCTGTCTCC
TGTTGTCAGGAAGCGTGTGGAGGTTCTCAGAGAGATTCAGGGTGAACATGATGAATTGGAGGCAAA
GTTTTTGGAAGAGAGAGCTGCTCTTGAAGCCAAATACCAAATTTTGTATCAACCATTGTACACTAA
GCGTTATGATATTGTGAATGGTGTTGCTGAAGTGGTAGGGGTACGAGTTGAAACTGCTGTTGCAGA
AGAGGATAAAGAGAAAGGAGTGCCTTCATTTTGGCTTAATGCTATGAAAACAATGATGTCGGAGG
TGAAGAAATTACAGAGCGCGATGAAGGCGCTCTCAAGTTTCTCAAAGATATCAAGTGGACAAGGAT
CGAAGAACCTAAAGGATTCAAACTTGAGTTTTTCTTCGATTCCAATCCCTATTTTTCAAACTCGGT
GTTGACCAAAATCTATCATATGGTTGATGAGGATGAGCCTATACTGGAGAAGGCTATTGGACTGA
AATTCAGTGGCTTCCAGGAAAATGCCTGACCCAAAAGGTTTTGAAGAAAAGCCCAAGAAGGGTGC
```

```
AAAGAATGCTAAACCAATTACCAAAACTGAAACCTGTGAAAGTTTCTTTAACTTTTTCAATCCACC
AGAAGTCCCTGAAGATGATGAAGACATTGATGAAGATATGGCTGAGGAACTTCAGAATCAGATGGA
ACAAGACTATGACATTGGGTCAACAATAAGAGATAAGATCATCCCCATGTCGTGGTTTACTGGGGA
GGCTGCTCAGGGAGAGGAGTTTGGAGACCTGGATGATGAAGATGAGGATGAGGACGATGATGCTGA
GGAGGATGATGAAGAGGAGGATGAGGACGAAGATGATGATGATGAAGAAGAGGAAGAGACTAAGAC
TAAAAGAAGTCATCTGCTAGTAAGAAGAGGATCGGAATTGCGCAGCTTGGCGATGGTCAGCAGGG
TGAAAGACCACCAGAGTGCAAGCAGCAGTAGTTTATTTATTCAGAGTATGATGCTACTGAAAGTTG
CTTTGGGGTCCTAGCGCCTGATGAAAAGAGTTCTCAATTTCATGTGGTTTTCATGGTCCTTAATT
CATTTTCCTCCCCTAGTTTTATTTTAGTCTGAATTTATTGAGTCTCTTGCCCCTTTTGTCCCTCT
CCTTTTGGAGAGATGGTGTTATATAGTCAGTGGTGGTGGTGTGATTTATTGGTACTTCAAGTTTAG
GTCTCCTTCCTAGATACTTAAAGTTGTGCTTGATTATTACCAATATTTTGGTATACTTTGATTAG
CAAAACGTTGCTACAAGTTTTCGCTTGAAGAAATATTGTAATGATTTTTCTTCTAAATGCATG
TTACAATTTTATT
```

SEQ ID NO: 36, AAB72115.1| NAP1Ps [Pisum sativum]

```
MTNNKEAFNISDLSSALNEEDRADLVNALKSKIQSLAGQHSDVLESLSPVVRKRVEVLREIQGEHD
ELEAKFLEERAALEAKYQILYQPLYTKRYDIVNGVAEVVGVRVETAVAEEDKEKGVPSFWLNAMKN
NDVGGEEITERDEGALKFLKDIKWTRIEEPKGFKLEFFFDSNPYFSNSVLTKIYHMVDEDEPILEK
AIGTEIQWLPGKCLTQKVLKKKPKKGAKNAKPITKTETCESFFNFFNPPEVPEDDEDIDEDMAEEL
QNQMEQDYDIGSTIRDKIIPMSWFTGEAAQGEEFGDLDDEDEDEDDDAEEDDEEEDEDEDDDEEE
EETKTKKKSSASKKRIGIAQLGDGQQGERPPECKQQ
```

SEQ ID NO: 37, L38856.1|SOYSNAP Glycine max nucleosome assembly protein 1 (SNAP-1) mRNA, complete cds

```
CTTCTCTCTAGGGTTTTAGCACTCTCTCTCTCTCGTTTTCGTTCTTCCTTTCTGCCTCTCTCAG
TCACACACCTTCTCGATGACCAACGACAACATCGCCGTCACAGATCTCACTTCTGCCCTCAATGAA
GAGAATCGCGCCGACCTAGTCAATGCTCTCAAGAGCAAGATTCAGAGTCTGGCTGGGGCGCATTCT
GATGTTCTAGAGACTCTATCCCCGAATGTCAGGAAGCGTGTTAATCTCTTAGAGAAATTCAGGGT
AAACATGATGAACTAGAGGCAGACTTCTTGAAGGAGAGAGAAGCTCTTGAAGCAAAGTACCAAAAA
CTGTATCAGCCATTGTACACAAAGCGCTATGAAATTGTAAATGGTGTTACTGAAGTGGAAGGGGCA
GCAAATGAATCAACAGATGAATCAGAAGAGAATAAAGAGAAAGGAGTGCCTTCTTTTGGCTCAAT
GCAATGGAAAATAATGATGTGTTAGCTGAAGAGATTTCAGAGCGTGATGAAGGTGCTCTCAAGTTT
CTTAAAGATATCAAGTGGAGCAGGATAGAAAATCCTAAAGGGTTCAAGCTTGATTTCTTCTTTGAT
ACCAATCCTTACTTTTCAAATACCGTCTTGACAAAAACATATCATATGATTGATGAGGATGAACCT
ATATTGGAGAAAGCAATTGGACGGAAATTGAATGGTACCCGGGAAAATGCTTGACTCAGAAGGTT
TTGAAGAAGAAGCCTAAGAAGGGTTCAAAGAATGCTAAACCAATTACCAAAACTGAAAGCTGTGAA
AGCTTCTTCAATTTTTTCAAACCACCAGAAGTCCCTGAAGATGATGCTGACATTGATGAAGATTTG
GCTGAAGAACTTCAGAATCAGATGGAACAAGATTATGACATTGGGTCAACATTAAGAGATAAAATT
ATCCCTCATGCTGTATCATGGTTTACTGGGGAGGCCGCTCAGGGAGATGAGTTTGAAGACCTGGAG
GATGATGAGGACGAAGAGGAAGATGAGGACGAAGATGAGGACGAAGAGGATGACGAGGACGAAGAC
GATGAAGAGGAGGATGACACTAAGACTAAAAAGAAGAAGAGTGGTAAGGCACAGGCTGGTGATGGT
GATGGTGAGCGACCTCCAGAGTGCAAGCAGCAGTAATTGTTTGTTTCTTCGGAGTATCATGTGGCT
GATGGGTGTTTTGAGGTCCTATGGTGCCTGACGGGAAAGTGGGTTTCAATTTCATGCAATTTTTC
ATAGTCCTTGATTCATTTTCCTCCCTAGATCCGATAGTCTGAATTTATTGAGTCAATTTCTCCTTT
TTCCCATATTTGGGAGAATGTGGTTATATATTTGTAGTCAGGGATGCTGTGATTTGTTACTGTTG
GAATTTGTACGTCATTCCAGACACTTCACATATATTATAGGTTGTGCTTTGTTACT
```

SEQ ID NO: 38, AAA88792.1| nucleosome assembly protein 1, Glycine max

MTNDNIAVTDLTSALNEENRADLVNALKSKIQSLAGAHSDVLETLSPNVRKRVESLREIQGKHDEL
EADFLKEREALEAKYQKLYQPLYTKRYEIVNGVTEVEGAANESTDSEENKEKGVPSFWLNAMENN
DVLAEEISERDEGALKFLKDIKWSRIENPKGFKLDFFFDTNPYFSNTVLTKTYHMIDEDEPILEKA
IGTEIEWYPGKCLTQKVLKKKPKKGSKNAKPITKTESCESFFNFFKPPEVPEDDADIDEDLAEELQ
NQMEQDYDIGSTLRDKIIPHAVSWFTGEAAQGDEFEDLEDDEDEEEDEDEDEEDDEDEDDEEED
DTKTKKKKSGKAQAGDGDGERPPECKQQ

SEQ ID NO: 39, Rice GOS 2 promoter variant

AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC

FIGURE 10 A

| | | | |
|---|---|---|---|
| TA0704@contig16414 | (41) | DQFANVVLQGACERVIVG------ELYCDVPLGLYVIRGE---NVVLIGELD |
| BN0204@contig12290 | (41) | DQFANAVLEGACERVIVG------EQYCDIPLGLYVIRGE---NVVLIGDLD |
| BN0204@contig30411 | (41) | DQFANAVLEGACERVIVG------EQYCDIPLGLYVIRGE---NVVLIGDLD |
| BN04FL@41982578 | (33) | DTWMNIHLREVICTSKDGD------RFWRMPECYIRGN---TIKYLRVPD |
| BN04FL@42120216 | (33) | DTWMNIHLREVICTSKDGD------RFWRMPECYIRGN---TIKYLRVPD |
| BN04FL@42952553 | (33) | DTWMNIHLREVICTSKDGD------RFWRMPECYIRGN---TIKYLRVPD |
| BNM01@BN04MC02973_421805 07 | (8) | DQFANAVIEEAYERVIVG------DLYCDIPLGLYIIRGE---NVVLIGELD |
| GM04FL@GM02LC15807 | (40) | DVYVNMVLEDVTEYEITAE------GRRITKLDQILLNGNNIAILVPGG |
| GM04FL@GM06LC5469 | (33) | DTWMNIHLREVICTSKDGD------RFWRMPECYIRGN---TIKYLRVPD |
| GM04FL@GM06LC725 | (33) | DTWMNIHLREVICTSKDGD------RFWRMPECYIRGN---TIKYLRVPD |
| GM04FL@GM06MC03669 | (33) | DTWMNIHLREVICTSKDGD------RFWRMPECYIRGN---TIKYLRVPD |
| HV04FL@62658793 | (41) | DQFANVVLQGACERVIVG------ELYCDVPLGLYVIRGE---NVVLIGELD |
| HV04FL@63122459 | (33) | DQATNIILDESHERVYSTK------EGVQQLVLGLYIIRGD---NISVIGELD |
| LU04FL@62341874 | (33) | DTWMNIHLREVICTSKDGD------KFWRMPECYIRGN---TIKYLRVPD |
| TA04FL@TA02LC24263 | (41) | DQFANVVLQGACERVIVG------GQYCDVPLGLYVIRGE---NVVLIGELD |
| TA04FL@TA02LC45139 | (33) | DTWMNIHLREVICTSKDGD------KFWRMPECYIRGN---TIKYLRVPD |
| ZM04404@contig12257 | (33) | DTWMNIHLREVICTSKDGD------HMLSVRNCFIRGS---VVRYVQLPK |
| ZM04FL@ZM06LC6366 | (33) | DQYLNIKLENTRVVDQDKYP------DLYCDIPLGLYIIRGE---NVVLIGELD |
| At1g03330_Lsm2 | (41) | DQFANAVLEEAYERVIVG------DLYCDIPLGLYIIRGE---NVVLIGELD |
| AT1G19120_Lsm1a | (41) | DQHLNMILGDVEEVITTIE------IDDETYEEIVRTTKRTVPFLFVRG |
| AT1G21190_Lsm3a | (42) | DQHLNMILGDVEEVITTIE------IDDETYEEIVRTTKRTVPFLFVRG |
| AT1G65700_Lsm8 | (33) | DQATNIILDESHERVFSTK------EGVQQHVLGLYIIRGD---NIGVIGELD |
| At1g76860_Lsm3b | (42) | DQHLNMILGDVEETITTVE------IDDETYEEIVRTTKRTIEFLFVRG |
| AT2G03870_LMs7 | (37) | DQLLNLVLDEAVEFVRDHDDPLKTTDQTRRLGLIVCRGT---AVMLVSPTD |
| AT2G43810_Lsm6b | (45) | DGYMNIAMEQTEEYVN-GQ------LKNTYGDAFVRGN---NVLYISTTK |
| AT3G14080_Lsm1b | (41) | DQFANAVLEGACERVIVG------EQYCDIPLGLYVIRGE---NVVLIGELD |
| AT3G59810_Lsm6a | (45) | DGYMNIAMEQTEEYVN-GQ------LKNKYGDAFIRGN---NVLYISTVN |
| AT5G27720_Lsm4 | (33) | DTWMNIHLREVICTSKDGD------RFWRMPECYIRGN---TIKYLRVPD |
| AT5G48870_Lsm5 | (40) | DVYVNMVLEDVTEYEITAE------GRRVTKLDQILLNGNNIAILVPGG |
| Os01g0256900 | (33) | DTWMNIHLREVICTSKDGD------KFWRMPECYIRGN---TIKYLRVPD |
| Os01g0866700 | (49) | DQHLNMILGDVEEIVTTVE------IDDETYEEIVRTTKRTIPFLFVRG |
| Os04g0388900 | (51) | DGYMNIAMEQTEEYVN-GQ------LKNKYGDAFIRGN---NVLYISTSK |
| Os05g0389300 | (41) | DQFANAVLEGACERVIVG------EQYCDIPLGLYVIRGE---NVVLIGELD |
| Os04g0445800 | (42) | DVYVNMVLEDVTEYEYTAE------GRRITKLDQILLNGNNIAILVPGG |
| Os05g0594900 | (34) | DQFANVVLQGACERVIVG------ELYCDVPLGLYVIRGE---NVVLIGELD |
| Os08g0177700 | (37) | DQATNIILDESHERVYSTR------EGVQQLVLGLYIIRGD---NISVVGEVD |
| Consensus | (51) | DQWMNIVL EV E V GD      LE IRGN NI YLX |
| | | Lsm-I motif           Lsm-II motif |

MOTIF I

FIGURE 10 A (continued)

| | | 101 | | 150 |
|---|---|---|---|---|
| TA0704@contig16414 | (84) | REKDELPSHMTCVSEAEIRTAE | KAEKEARDLKGTMRKRMEFLDFD | ------ |
| BN0204@contig12290 | (84) | TEREELPPNMIRVSETEIKRAQ | KVEREASELRGTMRKRMEFLDFD | ------ |
| BN0204@contig30411 | (84) | TEREELPPNMIRVSETEIKRAQ | KVEREASELRGTMRKRMEFLDFD | ------ |
| BN04FL@41982578 | (74) | EVIDKVQEE--KTRTDRKPPGV | GRGRGRG--------------- | ------ |
| BN04FL@42120216 | (74) | EVIDKVQEE--KTRTDRKPPGV | GRGRGRG--------------- | ------ |
| BN04FL@42952553 | (74) | EVIDKVQEE--KTRTDRKPPGV | GRGRGRG--------------- | ------ |
| BNM01@BN04MC02973_42180507 | (51) | IEKEELPAQMVQVSEAEIKRAQ | KAEKEEMLLKGLMRKRMEFLDLD | ------ |
| GM04FL@GM02LC15807 | (83) | SPESE----------------- | ---------------------- | MDDGG |
| GM04FL@GM06LC5469 | (71) | EVIDKVQEET-KSRTDRKPPGV | GRGRGRGREDGPGGRQPKGIGRG | LDEGG |
| GM04FL@GM06LC725 | (74) | EVIDKVQEET-KSRTDRKPPGV | GRGRGRGRDDGPGGRQPKGIGRG | IDEGG |
| GM04FL@GM06MC03669 | (74) | EVIDKVQEET-KSRTDRKPPGV | GRGRGRGRDDGPGGRQPKGIGRG | IDEGG |
| HV04FL@62658793 | (74) | EVIDKVQEETSKSRSDRKPPGV | GRGRGRGDIGTKPGG--RGIGRG | QDDGK |
| HV04FL@63122459 | (84) | REKDELPSHMTCVSEAEIRTAE | KAEKEARDLKGTMRKRMEFLDLD | ------ |
| LU04FL@62341874 | (77) | EELD------------------ | -AHPLKPVIH------------ | ------ |
| TA04FL@TA02LC24263 | (74) | EVIDKVQEETSKSRSDRKPPGV | GRGRGRGDIGTKPGG--RGIGRG | QDDGK |
| TA04FL@TA02LC45139 | (74) | EVIDKVQEETSKSRSDRKPPGV | GRGRGRGDIGTKPGG--RGIGRG | QDDGK |
| ZM04@contig12257 | (84) | HEKDELPAHMTCVLEAEIRKAE | KAEREARDLKGTMRKRMEFLDFD | ------ |
| ZM04FL@ZM06LC6366 | (74) | EVIDKVQEETSKSRSDRKPPGV | GRGRGRGDVGAKPGG--RGIGRG | QDDGG |
| At1g03330_Lsm2 | (75) | DGVDVDLLHDAARREARGG--- | ---------------------- | ------ |
| AT1G19120_Lsm1a | (84) | VEKEELPAHMVQVPEAEIKRAQ | KAEKEEMLLKGTMRKRMEFLDLD | ------ |
| AT1G21190_Lsm3a | (85) | DGVILVSP?LRTT--------- | ---------------------- | ------ |
| AT1G65700_Lsm8 | (77) | EELD------------------ | -ASLDFSKLF------------ | ------ |
| At1g76860_Lsm3b | (85) | DGVILVSP?LRTAA-------- | ---------------------- | ------ |
| AT2G03870_LMs7 | (85) | GTEEIANPFVTAEAV------- | ---------------------- | ------ |
| AT2G43810_Lsm6b | (85) | GTLSDGA--------------- | ---------------------- | ------ |
| AT3G14080_Lsm1b | (84) | TEREELPPHMIRVSEAEIKRAQ | KVEREASELRGTMRKRMEFLDFD | ------ |
| AT3G59810_Lsm6a | (85) | MTVADGA--------------- | ---------------------- | ------ |
| AT5G27720_Lsm4 | (74) | EVIDKVQEE--KTRTDRKPPGV | GRGRGRG--------------- | VDDGG |
| AT5G48870_Lsm5 | (83) | SPEDGE---------------- | ---------------------- | ------ |
| Os01g0256900 | (74) | EVIDKVQEETSKSRSDRRPPGV | GRGRGRGRGDIGTKPGG--RGIGRG | QDDGG |
| Os01g0866700 | (92) | DGVILVSP?LRTA--------- | ---------------------- | ------ |
| Os04g0388900 | (91) | RTLTDDA--------------- | ---------------------- | ------ |
| Os05g0389300 | (84) | SPPDVA---------------- | ---------------------- | ------ |
| Os04g0445800 | (85) | REKDELPAHMTCVSEAEIRKAE | KAEREARDLKGSMRKRMEFLDFD | ------ |
| Os05g0594900 | (78) | EELD------------------ | -ARLDLSNLF------------ | ------ |
| Os08g0177700 | (85) | GTDEIANPFQSDGA-------- | ---------------------- | ------ |
| Consensus | (101) | E  ID V              G | R                       | |
| | | | Motif II | |

FIGURE 10 A (continued)

| | | 151 | | 177 |
|---|---|---|---|---|
| TA0704@contig16414 | (129) | ------------------------- | | |
| BN0204@contig12290 | (129) | ------------------------- | | |
| BN0204@contig30411 | (129) | ------------------------- | | |
| BN04FL@41982578 | (106) | ARG---RGRGAPMAKMSGNRGAGRGRG | | |
| BN04FL@42120216 | (106) | ARG---RGRGAPMAKMSGNRGAGRGRG | | |
| BN04FL@42952553 | (106) | ARG---RGRGAPMAKMSGNRGAGRGRG | | |
| BNM01@BN04MC02973_421805 07 | (96) | ------------------------- | | |
| GM04FL@GM02LC15807 | (88) | ------------------------- | | |
| GM04FL@GM06LC5469 | (123) | PKGQGGRGRGGPGGKPGGNRGGGRGRG | | |
| GM04FL@GM06LC725 | (123) | AKGQGGRGRGGPGGKPSGNRGAGRGRG | | |
| GM04FL@GM06MC03669 | (123) | AKGQGGRGRGGPGGKPSGNRGAGRGRG | | |
| HV04FL@62658793 | (122) | ---GGGRGRGGIGSK-GGNKGG-RGRG | | |
| HV04FL@63122459 | (129) | ------------------------- | | |
| LU04FL@62341874 | (99) | ------------------------- | | |
| TA04FL@TA02LC24263 | (122) | ---GGGRGRGGIGSK-GGNKGG-RGRG | | |
| TA04FL@TA02LC45139 | (122) | ---GGGRGRGGIGSK-GGNKGG-RGRG | | |
| ZM0404@contig12257 | (129) | ------------------------- | | |
| ZM04FL@ZM06LC6366 | (122) | -RGSGGRGRGGVGAK-GGNKGGGGRGRG | | |
| At1g03330_Lsm2 | (94) | ------------------------- | | |
| AT1G19120_Lsm1a | (129) | ------------------------- | | |
| AT1G21190_Lsm3a | (98) | ------------------------- | | |
| AT1G65700_Lsm8 | (99) | ------------------------- | | |
| At1g76860_Lsm3b | (99) | ------------------------- | | |
| AT2G03870_LMs7 | (100) | ------------------------- | | |
| AT2G43810_Lsm6b | (92) | ------------------------- | | |
| AT3G14080_Lsm1b | (129) | ------------------------- | | |
| AT3G59810_Lsm6a | (92) | ------------------------- | | |
| AT5G27720_Lsm4 | (106) | ARG---RGRGTSMGKMGGNRGAGRGRG | | |
| AT5G48870_Lsm5 | (89) | ------------------------- | | |
| Os01g02569 00 | (122) | SKGGGGRGRGGIGGK-GGIKGGGRGRG | | |
| Os01g0866700 | (105) | ------------------------- | | |
| Os04g0388900 | (98) | ------------------------- | | |
| Os05g0389300 | (90) | ------------------------- | | |
| Os04g0445800 | (130) | ------------------------- | | |
| Os05g0594900 | (100) | ------------------------- | | |
| Os08g0177700 | (99) | ------------------------- | | |
| Consensus | (151) | | | |

FIGURE 10 A (continued)

SEQ ID NO 40, Arabidopsis thaliana - DNA

CCATAGATCTCAAGTCTCTCTCTCTTAGTGAATAAATTAGGGTTCGTTGATTCTCTGTTCTTAAGC
TCAGTAATCGAGGAGAAGAAGAAAAGGGAAGATCGGGAATTGGGAAACTGAGAAGTCAAAAAGGCA
AATGCGAGTGGAGGAGATTGAGTTTTAGAATTCCAATGTCTTGGGCTGCTCCTGATGATATCTTCT
TCTCCACTTCTCTTGCTGCTTACCTAGACAAGAAACTTCTTGTGTTGCTTCGTGATGGTAGGAAAC
TGATGGGTCTACTTCGGTCCTTTGATCAATTTGCTAATGCTGTTTTAGAAGAAGCTTATGAAAGAG
TCATTGTGGGTGATCTCTACTGTGATATTCCCTTAGGTCTATACATTATCCGTGGAGAAAATGTTG
TCTTGATTGGTGAATTGGACGTGGAAAAAGAAGAGCTTCCAGCTCATATGGTTCAGGTTCCAGAAG
CAGAGATAAAAAGGGCTCAGAAAGCAGAGAAGGAAGAAATGCTTTTAAAGGGCACAATGCGGAAAA
GAATGGAGTTCCTTGATCTCGATTAGGGCATTTTCCTATGTGTTGCAGCATTGTAGAAACTAGAAG
ATCTCAAGATGGAGGATACAGAAGATCCTTAAACGTCATAATGTTAGTTGATGTGTGTATGTGTGG
ATGACATTGATGAATCCTCAGAACTTAGTCGTTGCAGATCCTCTGCTCTGTTTATGGAATGAAATT
GTTGAGCCTGTTC

SEQ ID NO 41, Arabidopsis thaliana - protein

MSWAAPDDIFFSTSLAAYLDKKLLVLLRDGRKLMGLLRSFDQFANAVLEEAYERVIVGDLYCDIPL
GLYIIRGENVVLIGELDVEKEELPAHMVQVPEAEIKRAQKAEKEEMLLKGTMRKRMEFLDLD

SEQ ID NO 42, Arabidopsis thaliana - DNA

GACGGATTTGCTCGCTAGTTTTCTCTTCGAATTTTCCACAAACAAATTTTCTCAGCCAAAGTTCGA
TCGGATCTGGGTTTTATATTTTTTGAAGAACCCGTGTCCGTCTTCGATCAGGTGTCGAAAGTCTC
AATCTTTTTTAATCACTTTATCAATTTAAACCCTTTGGTCAAAACCCTAATTTAGATTTCTCTTTC
CGTCTTCACTTTTTTTTTTCCTGTCAAAGTTCGCGTTCAATAGCCAAATCTTATCTCTTCAGCTG
GAATCTGACGAACATTATTATCATCGGTAGTGTTCTATAGAAAGACCGAAAGTTTTCTTCAATTTC
AAAGTCAGTGGCGATGTCGTGGGCTGGTCCTGAAGAAATTTATCTTTCAACATCACTCGCTAGTTA
TCTCGATAGAAAACTACTTGTGCTTCTTAGAGATGGTAGAAAGCTAATGGGAACACTCCGTTCCTT
TGATCAATTCGCCAATGCGGTTCTAGAAGGTGCGTGTGAGAGGGTAATTGTTGGTGAACAATACTG
TGACATTCCTTTAGGCCTCTATGTAATCCGTGGAGAGAATGTTGTTTTGATTGGTGAGCTGGACAC
GGAGAGAGAAGAGCTTCCTCCACATATGATTCGCGTCTCAGAGGCAGAGATTAAAAGGGCACAAAA
GGTGGAGAGGGAAGCGAGTGAGCTGAGAGGAACAATGAGGAAGAGAATGGAGTTTCTTGACTTTGA
TTAAACCAGATTGTATCCCCATTCATTATTGGCTTGATGCTCTGCTTTGGCTCGCAAGTTTATGA
TGAGCCTTTTGGTGTGTTGACTTAGGGGATCGACGCAATTCTTGTGTTTCATTTTGGATGAATAT
GACAATAAATCTGTGTACTTTTGTCTTTGGATCTATTTACCTTTTTAAGAAAAAAATGTTAAGC

SEQ ID NO 43, Arabidopsis thaliana - protein

MSWAGPEEIYLSTSLASYLDRKLLVLLRDGRKLMGTLRSFDQFANAVLEGACERVIVGEQYCDIPL
GLYVIRGENVVLIGELDTEREELPPHMIRVSEAEIKRAQKVEREASELRGTMRKRMEFLDFD

FIGURE 12

SEQ ID NO 44, Arabidopsis thaliana - DNA

ATGTTGTTCTTTTCTTACTTCAAGGATTTGGTTGGACAAGAAGTGACGGTTGAGCTGAAGAATGAT
TTAGCCATAAGAGGAACTCTTCACTCAGTTGATCAGTATCTGAATATCAAGCTCGAGAACACTAGG
GTTGTTGACCAGGACAAGTACCCTCACATGCTTTCAGTGAGAAACTGTTTCATCAGAGGATCTGTG
GTAAGGTACGTGCAGTTACCTAAAGATGGAGTCGATGTTGATTTGCTTCACGACGCAGCTAGAAGA
GAAGCTAGGGGTGGCTGA

SEQ ID NO 45, Arabidopsis thaliana - protein

MLFFSYFKDLVGQEVTVELKNDLAIRGTLHSVDQYLNIKLENTRVVDQDKYPHMLSVRNCFIRGSV
VRYVQLPKDGVDVDLLHDAARREARGG

SEQ ID NO 46, Arabidopsis thaliana - DNA

CGAGAGCACTACAATTTCAAAACCCTCGGAGAAGTTATAATCAGAAAATGTCAGTCGAGGAAGACG
CCACCGTTAGAGAGCCACTCGATCTGATTCGGTTGAGTATCGAAGAGAGGATCTATGTCAAGCTCC
GATCTGACCGTGAACTCCGCGGCAAGCTTCACGCTTTTGATCAGCATTTGAATATGATTCTGGGTG
ATGTTGAAGAGGTTATTACGACTATAGAAATCGACGACGAGACATATGAAGAGATTGTTCGGACAA
CGAAGCGAACGGTACCGTTTCTATTCGTGAGAGGAGATGGAGTGATATTGGTGTCACCGCCTTTGA
GGACGACCTAAATGTTCTTGTGTACTGGATCGGAGTTAACAAATCTGGCGCTGAGTAAAAGCACT
TTTTTCTGATTACTTGGCTTTTGAATTTGTAATTGTGTGGTATGTTTTTCTTTGTTGTCAAACATT
GAAACCGAATGTAGCATTCGAATCTTGGTAATGGGTGCCTCGTTATAGTAGAATCAGTGTAACATA
CTTCGTATTGTGACTTTCTTACCGTTTACGATCGGATTTAGTTTCGTTTTCTGGTTTGGTGTAGTT
TTCTCTAAAGATTTGTATACTTCCTCAAACTCATTGATTTCGAGCTCTATTATGAATA

SEQ ID NO 47, Arabidopsis thaliana - protein

MSVEEDATVREPLDLIRLSIEERIYVKLRSDRELRGKLHAFDQHLNMILGDVEEVITTIEIDDETY
EEIVRTTKRTVPFLFVRGDGVILVSPPLRTT

SEQ ID NO 48, Arabidopsis thaliana - DNA

ATGTCCGGCGAGGAAGAAGCCACCGTGAGGGAGCCACTAGATCTGATTAGGCTGAGTCTCGACGAG
AGAATCTATGTCAAGCTCCGGTCAGACCGCGAACTTCGCGGCAAGCTTCACGCGTTTGATCAGCAT
TTGAATATGATTCTGGGTGATGTTGAAGAAACTATCACTACAGTAGAAATCGATGACGAGACATAT
GAAGAGATTGTTCGGACTACAAAGCGGACGATTGAGTTTCTATTCGTGAGAGGAGATGGAGTGATA
TTGGTGTCTCCACCGCTGAGGACAGCAGCCTGA

SEQ ID NO 49, Arabidopsis thaliana - protein

MSGEEEATVREPLDLIRLSLDERIYVKLRSDRELRGKLHAFDQHLNMILGDVEETITTVEIDDETY
EEIVRTTKRTIEFLFVRGDGVILVSPPLRTAA

FIGURE 12 (continued)

SEQ ID NO 50, Arabidopsis thaliana - DNA

AAAACTAAAAGACCACCGATTCATTAGAAATCCATCCCTCTCACTGTCAAAACCCGAGAAGCAGAA
AAAAGCAAAAAACAGATTTCGAAGTTTCGACGCCTCTCTATTCTTCGATCTCTTTCATATTTGAAT
CGTTCACCTTCTTGCCGATCTTCGGAGTATATTACAAGGTTCTTAACGGATCTCTAAATCTTCTGA
TTTAAGAAGATGCTTCCTCTATCGCTGCTTAAAACTGCTCAAGGGCATCCTATGCTCGTGGAGCTT
AAGAATGGAGAGACATACAATGGGCATTTGGTGAATTGTGATACTTGGATGAACATCCATCTGCGT
GAAGTCATATGTACATCAAAGGACGGAGATAGATTTTGGAGGATGCCGGAATGTTATATCCGTGGT
AACACAATCAAGTACCTTCGAGTTCCGGATGAGGTGATTGATAAAGTACAGGAGGAGAAGACACGC
ACAGATAGAAAACCACCAGGTGTTGGACGTGGAAGAGGACGTGGTGTGGATGATGGAGGAGCCAGA
GGCAGAGGCAGAGGAACTTCAATGGGGAAGATGGGTGGCAACAGAGGAGCAGGTCGCGGCCGTGGT
TGATGCAACAAGTTTTAAAGACTCGCTGCCAAATCTGCTAACTTCCCATTGTGGAGAAAACCAAAA
GTTACATAAGAAGTTGGTCTGTTGTTGGTTTTCTATTAAGTATGTAAGGGATAGGGAGTGTGTTTT
TCGATTCTCCTTGTGATCTTTTCGAAAAATGAAATTTGTCTTTTGCCTTTTTGTGGTATATGTGAA
ATTCCAATTGTTTTCATTTGCGCTTAAAAATGAATCTTTCAGGTCTTGAATTTATATAATTGTTAG
AGAATTT

SEQ ID NO 51, Arabidopsis thaliana - protein

MLPLSLLKTAQGHPMLVELKNGETYNGHLVNCDTWMNIHLREVICTSKDGDRFWRMPECYIRGNTI
KYLRVPDEVIDKVQEEKTRTDRKPPGVGRGRGRGVDDGGARGRGRGTSMGKMGGNRGAGRGRG

SEQ ID NO 52, Arabidopsis thaliana - DNA

ATGGCGAACAATCCTTCACAGCTTCTTCCTTCAGAGCTAATCGATAGGTGTATAGGGTCTAAGATT
TGGGTGATAATGAAAGGAGATAAGGAGCTCGTTGGTATTCTCAAAGGATTCGATGTTTATGTCAAC
ATGGTTCTTGAAGATGTCACCGAATATGAGATTACGGCAGAAGGAAGACGGGTCACAAAGCTTGAT
CAGATTCTACTCAATGGCAACAACATCGCCATTCTGGTGCCAGGTGGGTCTCCCGAAGATGGAGAA
TGA

SEQ ID NO 53, Arabidopsis thaliana - protein

MANNPSQLLPSELIDRCIGSKIWVIMKGDKELVGILKGFDVYVNMVLEDVTEYEITAEGRRVTKLD
QILLNGNNIAILVPGGSPEDGE

SEQ ID NO 54, Arabidopsis thaliana - DNA

AAATAATAAAAGCCCTTAGGACCGATTCGTTATTTCTTCGCTCTCTCTTTCTCTCTGTGTCTCGTA
CTCGAGTAGGTCTCAGTTACGTAAAGGATCGAGCTTAAAGATGAGTGGAGTTGAAGAGAAAGTTT
CTGGAACGACAAAGACACCTGCAGATTTCCTCAAATCCATCCGTGGGAGACCCGTTGTTGTCAAGC
TCAATTCTGGTGTTGATTATCGAGGCACTCTTACTTGTCTTGATGGATATATGAACATAGCAATGG
AGCAGACGGAGGAGTATGTAAACGGGCAGCTCAAGAACAAATATGGTGACGCCTTTATCCGTGGAA
ACAACGTTCTTTACATCAGTACAGTAAACATGACTGTAGCAGACGGAGCCTAGGCCCATCATGATC
ATCAACAACAACAGTGGTCATGTTATGGCTGCCATTTTGTTGTCTTCTTCTACCTCATATTA
AAAGAGTAGTAGACATGTACCAAGATTGTCATCCTATGTTCTTCAGTAGATTTTGGGATACAGAC
ATCACTTTTTTCTTAGTAATATGATACTCTTCCATGTGACCCCAGATAAAGAAGAAAAATTATTAA
TTTATGGCTTGATACAATCATACAAGCAAAC

FIGURE 12 (continued)

SEQ ID NO 55, Arabidopsis thaliana - protein

MSGVEEKVSGTTKTPADFLKSIRGRPVVVKLNSGVDYRGTLTCLDGYMNIAMEQTEEYVNGQLKNK
YGDAFIRGNNVLYISTVNMTVADGA

SEQ ID NO 56, Arabidopsis thaliana - DNA

GCTCTGTTCGGCTGCTTCATCGAGCGGAAGTCTCTAGCCAATTACCGTTTGTTCGTGGACTCGAGA
TATTGTGGTTTCTTAGCAAAGAAGATGAGTGGAGTTGGAGAGAAAGCTTCTGGAACAACTAAGACA
CCTGCTGATTTCTTGAAATCTATCCGTGGTAAACCAGTTGTTGTCAAGCTCAACTCTGGTGTTGAT
TATCGAGGCATTCTTACTTGTCTTGATGGATATATGAACATCGCAATGGAGCAAACCGAAGAGTAT
GTAAATGGCCAGCTGAAGAACACATATGGCGACGCTTTTGTCCGTGGCAACAATGTTCTTTACATC
AGCACAACAAAGGGGACATTGTCAGATGGAGCATAGCTCTCTTTCATCACCATGAATGTTCATCTT
CTTCTCTACCTCTGGCATATGACAAATGTAGGATTTGTAGCAACCAGAGTTTATCACCACTGCATG
AATTCGACATGTCTTTTTCTTCCGCAACTCAGTTTGTGTCTAAATCATCTCCAAAATTCTGAGATA
TAGCTAGATTTTTATTTGTTATGAAATTTTTTTAATCACTGTTGGTCTTTGGAGCCTAATTATCG
TGTTTTGATGACGCAATCACTGCGTCACAATCTGATGTCATCTTAACAATCATTAATGTATTTTTT
TTTTCTTTTCTCGTAATATTCTTAATTATTCTTCGACAGCAAAGGTTTAAAAACTCCTTATTTCAA
TCATTAATGTATTTATGATTTGATCGAATAACAATAATATAGCTTATTTTGTTCT

SEQ ID NO 57, Arabidopsis thaliana - protein

MSGVGEKASGTTKTPADFLKSIRGKPVVVKLNSGVDYRGILTCLDGYMNIAMEQTEEYVNGQLKNT
YGDAFVRGNNVLYISTTKGTLSDGA

SEQ ID NO 58, Arabidopsis thaliana - DNA

GTCACTAGGAAGCTGCGACTATTTGACTGACTCTGATTTCACGCGACTCCTTGTGAGATTCTCCGA
TTGCTTCGCCTGAGTTTCTGGGTTAACTCTCCACGCCGTCACTTTGATCTTTGCTTTTCCGATCTT
TAGGGTTTTTGTTTAGGGAATTGTCGAAGACTCTGCTCTAACATGTCTGGAAGAAAAGAAACGGTT
TTAGATTTGGCCAAGTTTGTAGATAAGGGTGTGCAAGTTAAGCTCACTGGTGGTAGACAAGTGACT
GGAACTCTTAAAGGCTATGACCAATTGCTTAATCTTGTTCTTGATGAAGCAGTCGAGTTCGTTCGA
GATCATGATGATCCTTTGAAGACTACGGATCAGACAAGACGCCTTGGTTTGATTGTTTGCCGTGGA
ACAGCGGTGATGCTTGTCTCACCAACCGATGGCACCGAAGAAATCGCTAACCCGTTCGTTACTGCA
GAGGCTGTCTAAAGACTTTCTTCTCAAAGAATATGTCTCTCTATTAGTTTAACTTGGCGATTTAGA
GAGTATTTCATCTAACTCTCTGGTGTGATGTTGGAAACATATATGTTCAATTTAAACAATTTGGAA
CATCA

SEQ ID NO 59, Arabidopsis thaliana - protein

MSGRKETVLDLAKFVDKGVQVKLTGGRQVTGTLKGYDQLLNLVLDEAVEFVRDHDDPLKTTDQTRR
LGLIVCRGTAVMLVSPTDGTEEIANPFVTAEAV

FIGURE 12 (continued)

SEQ ID NO 60, Arabidopsis thaliana - DNA

AAAAACACACGCCGGAGAGTTTTCTAAGAACAACAGTGACGAAAAGGTTTTTAGGGTTTCTTTACC
AATCAGAATCTCCGCCAAGTAACGATTTTCAGATTCCGAAGCAGCAAAGTTCAAATAATTTCCGAA
CTGTAACATGGCGGCAACTACTGGACTTGAGACTCTCGTCGATCAGATTATTTCGGTGATTACAAA
TGACGGACGCAACATTGTGGGAGTTCTTAAAGGTTTTGACCAGGCTACAAATATAATCCTTGATGA
ATCTCATGAACGTGTGTTTTCCACAAAGGAAGGAGTACAACAACATGTGTTGGGTTTGTACATCAT
CAGAGGGGACAACATAGGTGTTATCGGGGAGCTGGACGAGGAGCTTGATGCTAGTCTGGATTTTTC
GAAGCTGAGAGCCCATCCGTTGAAACCCGTAGTGCATTGATTGAATATAGTTATGGTGAGAAAATC
TAATTCTCTCATTCAAAGCCTAAAAACAAAGAGAAGATTTGATTGTAAACAATTTGGATAGTTTGT
TTTGATGTCTGGAGTTGTCTTATTTGTGTATCCTAAGGACAAAAGCTATATGATATTTTATGTCTT
AAACGTTTTGGTCGGAAACTTAAATCATACAATCTTTTGGACGGACCTAGGTTTGC

SEQ ID NO 61, Arabidopsis thaliana - protein

MAATTGLETLVDQIISVITNDGRNIVGVLKGFDQATNIILDESHERVFSTKEGVQQHVLGLYIIRG
DNIGVIGELDEELDASLDFSKLRAHPLKPVVH

SEQ ID NO 62, Medicago truncatula - DNA atgtcttgggctgcacctgatgagcttttactctctacttctcttgctacatatcttgacaaaaa
cttcttgtcctgttgcgagatgggcggaaacttttgggtttattacgctcatttgatcaatttgct
aatgtcgttctagaaggtgcgtgtgaacgagtgattgtcggtgatctttattgtgatgtcccttta
ggcctttatgtaattcgtggggagaatgttgtcttaattggagagctggacttgggaaggaggag
cttccaccacatatgacatgtgtgtcagaggctgacataagaaaggctcaaaaagcagaacgcgat
gctagtgatctgaagggaactatgaggaaaaggatggaattccttgattttgactaa

SEQ ID NO 63, Medicago truncatula - protein

MSWAAPDELLLSTSLATYLDKKLLVLLRDGRKLLGLLRSFDQFANVVLEGACERVIVGDLYCDVPL
GLYVIRGENVVLIGELDLGKEELPPHMTCVSEADIRKAQKAERDASDLKGTMRKRMEFLDFD

SEQ ID NO 64, Populus trichocarpa - DNA

ATGTCTTGGGCAGGCCCAGAAGATATCTACCTCTCTACTTCTCTTGCCAACTATCTTGATAAGAAG
CTTCTTGTGCTCCTACGAGATGGCCGAAAGCTCATGGGATTACTTCGTTCTTTTGATCAATTTGCC
AATGCTGTCCTTGAAGGTGCATGTGAAAGAGTTATTGTTGGTGACCTTTATTGCGACATCCACTTG
GGTCTATATGTGATTCGTGGGGAGAATGTTGTCTTAATTGGAGAGCTGGATTTGGAGAGGGAGGAG
CTTCCACCACATATGACTCGTGTTTCAGAAGCAGAGATTAGAAGGGCGCAGAAAGCAGAAGGGAG
GCAACAGATCTAAAAGGTACAATGAGGAAAAGAATGGAGTTCCTTGATTTGGACTAG

SEQ ID NO 65, Populus trichocarpa - protein

MSWAGPEDIYLSTSLANYLDKKLLVLLRDGRKLMGLLRSFDQFANAVLEGACERVIVGDLYCDIHL
GLYVIRGENVVLIGELDLEREELPPHMTRVSEAEIRRAQKAEREATDLKGTMRKRMEFLDLD

FIGURE 12 (continued)

SEQ ID NO 66, Oryza sativa - DNA

GCGTCAACCTCACACTTGACGATAGTTCCTTTCATCAATCACCCAGCTTTACTCCTCTTCTCCCCC
CGCCCCGCTTCACCAATCAATCCAAACCCTAGAGCAAATCCCCTCCCTCCCTTGCCGGAATCGCTC
GCAAGCTCCAGGCAGCCCCCACACCAGTCCGCGGCGGATCAGGGGGCGGGGCGATCTCTAGCGCCC
TCCGGGATTTGAAGGGTTCCGAGCGTCGGCGATGTCGTCGTGGGCCGGGCCCGACGAGATCTTCCT
CTCCACGTCCCTGGCCGGCTTCTTGGACAAGAAACTTATTGTCCTACTACGAGATGGACGGAAGCT
GCTTGGCACACTCTGCTCATTTGATCAGTTTGCAAATGTTGTTCTTCAGGGTGCTTGTGAACGAGT
AATTGTAGGTGAACTATATTGTGATGTTCCTCTTGGTCTATATGTGATCCGGGGAGAGAATGTCGT
ATTAATCGGAGAATTGGATCGTGAGAAGGATGAACTCCCTGCTCACATGACTTGTGTTTCAGAGGC
TGAAATAAGAAAGGCCGAGAAAGCAGAAGGGAAGCGAGAGATCTGAAAGGTTCAATGAGGAAGAG
GATGGAGTTCTTAGACTTTGATTAGAATGGATTTGACCATCTTGATAGTTGCTGCTCCCACTATGG
CCGCGAGTTTTTAATGGCAGCCTCTGCTACATATGTGGGCTAATGAAAGCCAGATTTCGTTGTATC
TCATGCTGCTTGTTCAGCCAGAATTCTTCAGGTTGGAGATTTCAGTAAACATACTCTTTTACAGCG
GTAATGTACCTGTGTTCTTAAAATTTCTTCAG

SEQ ID NO 67, Oryza sativa - protein

MSSWAGPDEIFLSTSLAGFLDKKLIVLLRDGRKLLGTLCSFDQFANVVLQGACERVIVGELYCDVP
LGLYVIRGENVVLIGELDREKDELPAHMTCVSEAEIRKAEKAEREARDLKGSMRKRMEFLDFD

SEQ ID NO 68, Oryza sativa - DNA

GGGTAAGCTAGGGTTTAGGTCTCGGCGCGCGGCGGAGGGGAGGAGGAGGCGATGGCGGCGGCGGCG
GCGGCAGCGGCGGCTGAGGAGGAGATCGCGGTGAAGGAGCCGCTGGATCTGATCAGGCTCAGCCTC
GACGAGCGCATCTACGTCAAGCTCAGGTCCGACCGCGAGCTCCGCGGCAAGCTCCATGCATACGAT
CAACATTTAAACATGATTCTTGGAGATGTTGAGGAGATCGTGACAACAGTTGAGATTGACGATGAG
ACATATGAAGAAATTGTGCGCACCACAAAACGCACTATCCCCTTCCTTTTTGTTCGAGGTGATGGT
GTCATTTTGGTTTCTCCACCCCTCCGAACGGCATGAAGTATGAAGGAAGCTCCTGCCGATTGTCAA
CCATGAGTAATGTGTATTTTTAATCAATGGCATGTGTTATGTGCTGAAGTGCTACTATTTCTGAT
GGATTCTAGTTTTAGCATATGATACAATTGTGTAACAATTTCTGATCGAGGTGCTAGTTTCTACTG
TCATGTTGAATCAACCTTTTGTTACCAGATTAATCAACTCAATCCCGAAGC

SEQ ID NO 69, Oryza sativa - protein

MAAAAAAAAAEEEIAVKEPLDLIRLSLDERIYVKLRSDRELRGKLHAYDQHLNMILGDVEEIVTTV
EIDDETYEEIVRTTKRTIPFLFVRGDGVILVSPPLRTA

SEQ ID NO 70, Oryza sativa - DNA

ATTTGGGACACGTGTACATAACTCTTTCGGTCCGGGACCCTCTCTTGTTTTCTTCGTTGCTCGCG
AGCTCTTCCCCCCTCGCCTCGCCTCCCCACCCAACAAGCCCGCGGCGGCGACTAGGGTTTTGACCC
CCCGGAATCCCCCCTCCTCTCGCCGCCTCCGCCTCCGCCGCCGCCTTCCTCCCCGCGCCGGCG
ACGATCTGCTCCTCCTCCCCCGCCGGCATCGCTGTTTCCGGATCTAGCGCAAGATGCTTCCGCTCT
CGCTCCTCAAGACCGCCCAGGGGCATCCCATGCTCGTGGAGCTTAAGAACGGCGAGACGTACAACG
GGCACTTGGTGAACTGCGACACGTGGATGAACATCCACCTCCGGGAGGTTATTTGCACCTCAAAGG
ATGGTGATAAGTTTTGGAGGATGCCAGAATGTTACATCCGTGGGAACACCATCAAGTATCTTCGGG

FIGURE 12 (continued)

```
TTCCTGATGAGGTGATTGACAAGGTCCAGGAAGAGACTTCAAAGAGCAGATCAGATAGGAGGCCAC
CAGGTGTAGGCCGCGGAAGAGGAAGAGGTGATATAGGTACTAAGCCTGGAGGCAGAGGCATTGGGC
GTGGCCAGGATGATGGTGGCAGCAAAGGCGGTGGTGGCCGTGGAAGGGGAGGAATTGGAGGTAAAG
GTGGCATCAAAGGTGGGGCCGCGGACGTGGGTGAGAGGGAAGGTCACTTGTGGGAATGCCGCTTT
TTTAAGGCTTTGTGTCACATAGATTGCTTTAGGAGGGTGAAGAATGGACTGGTGGAGTAAGCATTG
CTTTGCTTTATCATTTTGTGGTATGACCGAAAAATGTTTCATGGGTTCAGTAGTTACCAGTGAAGA
GGCAGCGGTTGGCCTGTCTCGAAACAATTTGTTTGATGTCTGGACCCTCGACTATATTGAATATTA
TTGTGGTTATTACTTTGACCTGTTCATCGC
```

SEQ ID NO 71, Oryza sativa - protein

```
MLPLSLLKTAQGHPMLVELKNGETYNGHLVNCDTWMNIHLREVICTSKDGDKFWRMPECYIRGNTI
KYLRVPDEVIDKVQEETSKSRSDRRPPGVGRGRGRGDIGTKPGGRGIGRGQDDGGSKGGGGRGRGG
IGGKGGIKGGGRGRG
```

SEQ ID NO 72, Oryza sativa - DNA

```
ACCCAAAGCAGAAGCCTCCGCCGCCGCAGCGCCGCTACTCTTGCATCGCCTCCGCCGTAGCCGCGC
GCGCCCTTCCCGTCGCCGCTTCCACCTCGATCTCCGCCGGAGAGGGCGTCCGCCGCCATGTCTCAG
AACAACCCCTCCCAGCTCCTCCCCTCAGAGCTGATTGACCGCTGCATCGGGTCCAAGATTTGGGTG
ATTATGAAGGGTGACAAGGAGCTCGTCGGCACTCTCTGTGGGTTCGATGTGTACGTCAACATGGTG
CTCGAGGACGTTACTGAGTATGAATACACTGCTGAAGGCCGTCGCATAACAAAGCTTGATCAGATA
CTCCTAAACGGCAACAATATAGCTATTTTGGTTCCTGGTGGTTCTCCCCCAGATGTGGCATAAGCA
AGCACTTCCGTGATATACCTGCTTGAGGCTGATGGAGGCACAGACCGGTGTTTCCTTACTTCAAAT
GTATTTCTTCCATTTGTGGCTGTACTGAACTTTCTTAGTTAACTGACCTGAAGTAGTGTACCTGCA
ACAGTTGCTCCTACATGATTTGGCAATGCTAAGTATGAGGTACCTCTTGTAGCTGTTTATTACCAT
TCTTCTGCAACCTGACTCAGTAAACACTAGGTGGTTGAAGAAACCTGATAATGGAGAGCATATCTA
CAATTGTTGTATTTGTGGTTC
```

SEQ ID NO 73, Oryza sativa - protein

```
MSQNNPSQLLPSELIDRCIGSKIWVIMKGDKELVGTLCGFDVYVNMVLEDVTEYEYTAEGRRITKL
DQILLNGNNIAILVPGGSPPDVA
```

SEQ ID NO 74, Oryza sativa - DNA

```
CTCTCTCTTTCTCACCCAACCCCAACTCTACACGCACGCGGCGACAGCGAGAGAGATGAGCACCGG
CGGCGGCGCGGACAAGTCCGGCGGCGGCGGCGGAGGGGCGGTGAAGACGCCCTCGGACTTCCTCAA
GTCGATCAGGGGACGCCCCGTCGTCGTCAAGCTCAACTCCGGCGTCGACTACGAGGTATTTTGGC
TTGCCTGGATGGGTATATGAACATTGCAATGGAGCAAACGGAAGAGTATGTGAATGGCCAACTCAA
GAACAAGTATGGTGATGCCTTCATAAGAGGCAACAATGTTCTATACATCAGCACTTCGAAGAGGAC
CCTTACGGATGACGCATAGATCGAGTGGAACAGAGTCGACTCTTTTTAACTTCAAAATCGTTAAGC
TGATTGGTTGTGATCTCTCTCTGACCCATGCTCGTACCTGCTGTTTTGAGGTGGGAAAATGTATTG
CATATTGCTAGACTTATCAGAAACTTCTTTAATGTAACTGTATCAGCTTTGCAAAGAACTTCCGGC
CAAGATCTCCAGTTGCATTT
```

SEQ ID NO 75, Oryza sativa - protein

MSTGGGADKSGGGGGGAVKTPSDFLKSIRGRPVVVKLNSGVDYRGILACLDGYMNIAMEQTEEYVN
GQLKNKYGDAFIRGNNVLYISTSKRTLTDDA

SEQ ID NO 76, Oryza sativa - DNA

GAAGAAAAAAAAGAGAAAAACACAACACCATCAACCCCCGCATCCGCCACCGCCGCCACCACCCC
CTAACTCCGATTTGAAGCGACCAGAGGCCGCGGCTAAGGTCCGGGATGTCGGGGCGCAAGGAGACG
GTGCTGGACCTGGCCAAGTTCGTCGACAAGGGCGTCCAGGTCAAGCTCACCGGCGGCAGGCAAGTT
ACAGGGACTTTGAAGGGCTATGACCAGCTTCTAAACTTGGTGCTTGATGAAGCGGTTGAATTTGAA
AGAGAGCAAGATGATCCATTGAAACTATCAGGGAAAACCAGACAGCTTGGTCTTATTGTCTGTAGG
GGTACAGCGGTGATGCTTGTATCGCCAACCGATGGAACGGACGAGATTGCCAACCCCTTCCAATCT
GATGGTGCATAAACCTGCAGGAGCTGATGGTTCTCCTAGTCAAGATCCATGCTCTCCCAGTAGAGA
GGCCTTTGTATTAACTCATGTAATCTGGTGCCACAGTCTCTTATGACTCGTGTCTCTTATGAACAC
CAGGTGGTGGTCTGTTCTGTACCACTCGAAACTGATTTCTGAAGATCCTTGCTTTGTG

SEQ ID NO 77, Oryza sativa - protein

MSGRKETVLDLAKFVDKGVQVKLTGGRQVTGTLKGYDQLLNLVLDEAVEFEREQDDPLKLSGKTRQ
LGLIVCRGTAVMLVSPTDGTDEIANPFQSDGA

SEQ ID NO 78, Oryza sativa - DNA

CTCTTTCTTCTCTCCAAAACACAAATCGTCGCCGCATCCCCTCAACTCCGGCGATCCCCTTGGCGG
CGGCGGCGGCTTCCCCAATCACCCCACTCCACCTGAACTACAGGATGGCGTCCGCCGGCCCGGGGC
TCGAATCGCTCGTCGACCAGATCATATCCGTCATCACAAACGATGGCCGCAACATTGTGGGGACAC
TCAGAGGATTCGATCAAGCCACCAACATCATCCTCGATGAGTCCCATGAGAGGGTCTATTCTACCA
GGGAGGGAGTGCAACAGCTTGTTCTTGGGTTGTACATCATAAGGGGCGACAACATCAGCGTGGTGG
GGGAGGTGGATGAAGAACTGGATGCGAGGCTGGATCTATCGAATCTGAGAGCGCACCCGCTGAAGC
CCGTGATCCACTAATGGAAACGAATGAATGATGTACTACTACTAGTAGTAAGCTAAACCTAAATGT
AGTGTTGTCCCAGAAGTTGTGAAGAAGTGGGTGCTAGTGTTGCCGATGAGTGAACTTCTTTAACGT
ACGCGAGGAAGTCCAGCAAGCGGATGAGCGAGCATGAAGAAGAATGTTATGGTTTTATGTGGTGGT
GGATGGGTGATGCATGTTTGTTGAACACGAACACAGACACAGTGACTCAGTGAGTGAAGATTTGGT
TTCCATTGTATTGTATTGTTTGTGCAGCTGTATCAATGTACATGAATGAGGAAGGCAG

SEQ ID NO 79, Oryza sativa - protein

MASAGPGLESLVDQIISVITNDGRNIVGTLRGFDQATNIILDESHERVYSTREGVQQLVLGLYIIR
GDNISVVGEVDEELDARLDLSNLRAHPLKPVIH

SEQ ID NO 80, Oryza sativa - DNA

ATGTCGTCGTGGGCCGGGCCCGACGAGATCTTCCTCTCCACGTCCCTGGCCGGCTTCTTGGACAAG
AAACTTATTGTCCTACTACGAGATGGACGGAAGCTGCTTGGCACACTCTGCTCATTTGATCAGTTT
GCAAATGTTGTTCTTCAGGGTGCTTGTAACGAGTAATTGTAGGTGAACTATATTGTGATGTTCCT
CTTGGTCTATATGTGATCCGGGGAGAGAATGTCGTATTAATCGGAGAATTGGTCTGGTTTTGGATT
GAGCAGGATCGTGAGAAGGATGAACTCCCTGCTCACATGACTTGTGTTTCAGAGGCTGAAATAAGA
AAGGCTGAGAAAGCAGAAAGGGAAGCGAGAGATCTGAAAGGTTCAATGAGGAAGAGGATGGAGTTC
TTAGACTTTGATTAG

FIGURE 12 (continued)

SEQ ID NO 81, Oryza sativa - protein

MSSWAGPDEIFLSTSLAGFLDKKLIVLLRDGRKLLGTLCSFDQFANVVLQGACERVIVGELYCDVP
LGLYVIRGENVVLIGELVWFWIEQDREKDELPAHMTCVSEAEIRKAEKAEREARDLKGSMRKRMEF
LDFD

SEQ ID NO 82, Linum usitatissimum - DNA

ATGGCTTCCGGTCTTGGACTCGAATCTCTTGTTGACCAAACTATTTCTGTGATCACAAATGATGGC
CGCAACATAGTGGGCAACTTGAAAGGCTTCGATCAGGCCACTAATATCATCCTCGATGAATCCCAT
GAACGTGTTTACTCCACCAAGGAAGGCGTGCAACAACTGGTTTTGGGCTTGTACATAATAAGGGGT
GATAATATAAGCGTGATTGGGGAGCTTGACGAGGAACTTGATGCGCAGCTTGATATGTCGAATCTC
AGAGCACATCCCCTCAAACCTGTGATTCATTGA

SEQ ID NO 83, Linum usitatissimum - protein

MASGLGLESLVDQTISVITNDGRNIVGNLKGFDQATNIILDESHERVYSTKEGVQQLVLGLYIIRG
DNISVIGELDEELDAQLDMSNLRAHPLKPVIH

SEQ ID NO 84, Brassica napus - DNA

ATGGGTCTACTTCGGTCATTTGATCAATTTGCAAATGCTGTAATAGAAGAAGCTTATGAAAGAGTC
ATCGTGGGTGATCTCTACTGTGATATTCCCTTGGGTCTTTACATAATCCGTGGAGAAAATGTTGTC
TTGATTGGTGAACTGGACATTGAAAGGAAGAGCTTCCTGCTCAAATGGTCCAAGTCTCAGAGGCA
GAGATCAAAAGGGCTCAGAAAGCAGAGAAGAAGAAATGCTACTGAAGGGTTTGATGCGGAAAAGA
ATGGAGTTCCTTGATCTCGATTAG

SEQ ID NO 85, Brassica napus - protein

MGLLRSFDQFANAVIEEAYERVIVGDLYCDIPLGLYIIRGENVVLIGELDIEKEELPAQMVQVSEA
EIKRAQKAEKEEMLLKGLMRKRMEFLDLD

SEQ ID NO 86, Brassica napus - DNA atgtcttgggctggtcctgaagatatttacctttcaacttcactcgctagttatctcgatagaaag
atacttgtgctccttagagatggtagaaagctaatgggaacgctccgttcatttgatcaattcgcc
aatgcggttttagaaggtgcgtgcgagagggtaattgttggtgagcaatactgcgacattccttta
ggcctctatgtaatccgtggagagaatgttgttctcattggtgaccttgacactgagagagaggag
cttcctccaaatatgattcgcgtctcagagacagagattaaaagggcgcaaaagtggagagggaa
gcgagtgagctgagaggaacaatgaggaagagaatggagtttcttgacttcgattaa

SEQ ID NO 87, Brassica napus - protein

MSWAGPEDIYLSTSLASYLDRKILVLLRDGRKLMGTLRSFDQFANAVLEGACERVIVGEQYCDIPL
GLYVIRGENVVLIGDLDTEREELPPNMIRVSETEIKRAQKVEREASELRGTMRKRMEFLDFD

FIGURE 12 (continued)

SEQ ID NO 88, Brassica napus - DNA

TCTTGGGCTGCTCCTGATGATATCTTCTTCTCCACTTCTCTCGCCGCCTACTTAGACAAGAAGCTT
CTTGTCTTGCTTCGTGATGGTCGGAAACTGATGGGTCTACTTCGGTCATTTGATCAATTTGCAAAT
GCTGTAATAGAAGAAGCTTATGAAAGAGTCATCGTGGGTGATCTCTACTGTGATATTCCCTTAGGT
CTTTACATAATCCGTGGAGAAAATGTTGTCTTGATTGGTGAACTGGACGTTGAAAAGGAAGAGCTT
CCTGCTCAAATGGTCCAAGTCTCAGAGGCAGAGATCAAAAGGGCTCAGAAAGCAGAGAAAGAAGAA
ATGCTACTGAAGGGTTTGATGCGGAAAAGAATGGAGTTCCTTGAT

SEQ ID NO 89, Brassica napus - protein mswagpediylstslasyldrkilvllrdgrklmgtlrsfdqfanavlegacervivgeqycdipl
glyvirgenvvligdldtereelppnmirvseteikraqkvereaselrgtmrkrmefldfd

SEQ ID NO 90, Brassica napus - DNA

ATGCTTCCTCTTTCGCTACTCAAGACTGCTCAAGGACATCCCATGCTTGTGGAGCTCAAGAATGGA
GAGACATACAATGGGCATTTAGTAAATTGCGATACGTGGATGAACATCCATCTGCGTGAAGTTATC
TGCACATCAAAGGATGGAGACAGGTTTTGGAGGATGCCGGAATGTTATATCCGTGGTAACACTATC
AAGTACCTTCGTGTTCCAGATGAGGTGATTGATAAAGTACAGGAGGAGAAGACCCGCACAGATAGG
AAACCACCAGGGGTTGGACGTGGAAGAGGACGTGGTATGGATGATGGAGGGGCCAGAGGACGAGGC
CGAGGAGCTCCAATGGCTAAGATGAGTGGCAACAGAGGAGCAGGGCGTGGGCGTGGTTGA

SEQ ID NO 91, Brassica napus - protein

MLPLSLLKTAQGHPMLVELKNGETYNGHLVNCDTWMNIHLREVICTSKDGDRFWRMPECYIRGNTI
KYLRVPDEVIDKVQEEKTRTDRKPPGVGRGRGRGMDDGARGRGRGAPMAKMSGNRGAGRGRG

SEQ ID NO 92, Brassica napus - DNA

ATGCTTCCTCTTTCGCTGCTCAAGACTGCTCAAGGGCATCCCATGCTTGTGGAGCTCAAGAATGGC
GAGACATACAATGGGCATTTAGTGAATTGTGATACGTGGATGAACATTCATCTTCGTGAAGTCATC
TGCACATCAAAGGACGGAGACAGGTTTTGGAGGATGCCGGAGTGTTACATCCGCGGTAACACGATC
AAGTACCTTCGAGTTCCAGATGAGGTGATTGATAAAGTACAGGAGGAGAAGACCCGCACAGATAGG
AAACCACCAGGGGTTGGCCGTGGGAGAGGACGTGGTATGGATGATGGAGGGGCCAGAGGCCGTGGC
CGAGGAGCTCCAATGGCGAAGATGAGTGGCAACAGAGGAGCAGGTCGTGGGCGTGGTTGA

SEQ ID NO 93, Brassica napus - protein

MLPLSLLKTAQGHPMLVELKNGETYNGHLVNCDTWMNIHLREVICTSKDGDRFWRMPECYIRGNTI
KYLRVPDEVIDKVQEEKTRTDRKPPGVGRGRGRGMDDGARGRGRGAPMAKMSGNRGAGRGRG

SEQ ID NO 94, Brassica napus - DNA

ATGCTTCCTCTTTCGCTGCTCAAGACTGCTCAAGGGCATCCCATGCTTGTGGAGCTCAAGAATGGA
GAGACGTACAATGGGCATTTAGTGAATTGTGATACGTGGATGAACATTCATCTGCGTGAAGTCATC
TGCACATCAAAGGACGGAGACAGGTTTTGGAGGATGCCGGAGTGTTATATCCGCGGTAACACTATC
AAGTACCTTCGAGTTCCAGATGAGGTGATTGATAAAGTACAGGAGGAGAAGACCCGCACAGATAGA
AAACCACCAGGGGTTGGACGTGGGAGAGGACGTGGTGTGGATGATGGAGGGGCCAGAGGCCGTGGT
CGAGGAGCTCCAATGGCGAAGATGAGTGGCAACAGAGGAGCAGGTCGTGGCCGTGGTTGA

FIGURE 12 (continued)

SEQ ID NO 95, Brassica napus - protein

MLPLSLLKTAQGHPMLVELKNGETYNGHLVNCDTWMNIHLREVICTSKDGDRFWRMPECYIRGNTI
KYLRVPDEVIDKVQEEKTRTDRKPPGVGRGRGRGVDDGGARGRGRGAPMAKMSGNRGAGRGRG

SEQ ID NO 96, Glycine max - DNA

ATGCTTCCCCTTTCCCTTCTCAAGACTGCCCAAGGCCACCCCATGCTGGTGGAACTGAAAAATGGG
GAGACTTATAACGGGCACTTGGTTAATTGTGATACATGGATGAACATCCATCTCCGAGAAGTCATT
TGTACCTCTAAAGATGGAGATAGATTTTGGCGTATGCCTGAGTGCTACATTCGTGGCAATACCATT
AAGTACCTTCGGGTTCCTGATGAGGTTATTGACAAAGTCCAGGAAGAAACAAAGAGCCGTACTGAT
CGCAAACCCCTGGTGTGGGACGTGGAAGGGGAAGAGGTAGGATGATGGTCCTGGTGGACGTCAA
CCTAAAGGAATTGGGCGAGGTATTGATGAGGGTGGAGCTAAAGGACAAGGAGGACGAGGCCGGGGT
GGTCCAGGTGGAAAACCCAGTGGAAACAGAGGTGCAGGGCGAGGTAGAGGTTGA

SEQ ID NO 97, Glycine max - protein

MLPLSLLKTAQGHPMLVELKNGETYNGHLVNCDTWMNIHLREVICTSKDGDRFWRMPECYIRGNTI
KYLRVPDEVIDKVQEETKSRTDRKPPGVGRGRGRGRDDGPGGRQPKGIGRGIDEGGAKGQGGRGRG
GPGGKPSGNRGAGRGRG

SEQ ID NO 98, Glycine max - DNA

ATGCTGCCCCTTTCCCTTCTCAAGACTGCCCAAGGCCACCCTATGCTAGTGGAACTGAAAAATGGG
GAGACTTATAACGGGCACTTGGTTAATTGTGATACATGGATGAACATTCATCTCCGAGAAGTCATT
TGTACCTCTAAAGATGGAGATAGATTTTGGCGTATGCCCGAGTGCTACATTCGCGGCAATACCATA
AAGTACCTTCGGGTTCCTGATGAGGTTATTGACAAAGTCCAGGAAGAAACAAAGAGCCGCACTGAT
CGCAAACCCCTGGTGTGGGACGTGGAAGAGGAAGAGGTAGGAGGATGGTCCTGGTGGACGTCAA
CCAAAAGGAATTGGGCGTGGCCTTGATGAAGGTGGACCTAAAGGACAAGGAGGACGAGGTAGGGGT
GGTCCCGGTGGAAAGCCTGGTGGAAACAGAGGTGGAGGGCGAGGTAGAGGTTGA

SEQ ID NO 99, Glycine max - protein

MLPLSLLKTAQGHPMLVELKNGETYNGHLVNCDTWMNIHLREVICTSKDGDRFWRMPECYIRGNTI
KYLRVPDEVIDKVQEETKSRTDRKPPGVGRGRGRGREDGPGGRQPKGIGRGLDEGGPKGQGGRGRG
GPGGKPGGNRGGGRGRG

SEQ ID NO 100, Glycine max - DNA

ATGCTTCCCCTTTCCCTTCTCAAGACTGCCCAAGGCCACCCCATGCTGGTGGAACTGAAAAATGGG
GAGACTTATAACGGGCACTTGGTTAATTGTGATACATGGATGAACATCCATCTCCGAGAAGTCATT
TGTACCTCTAAAGATGGAGATAGATTTTGGCGTATGCCTGAGTGCTACATTCGTGGCAATACCATT
AAGTACCTTCGGGTTCCTGATGAGGTTATTGACAAAGTCCAGGAAGAAACAAAGAGCCGTACTGAT
CGCAAACCCCTGGTGTGGGACGTGGAAGGGGAAGAGGTAGGATGATGGTCCTGGTGGACGTCAA
CCTAAAGGAATTGGGCGAGGTATTGATGAGGGTGGAGCTAAAGGACAAGGAGGACGAGGCCGGGGT
GGTCCAGGTGGAAAACCCAGTGGAAACAGAGGTGCAGGGCGAGGTAGAGGTTGA

FIGURE 12 (continued)

SEQ ID NO 101, Glycine max - protein

MLPLSLLKTAQGHPMLVELKNGETYNGHLVNCDTWMNIHLREVICTSKDGDRFWRMPECYIRGNTI
KYLRVPDEVIDKVQEETKSRTDRKPPGVGRGRGRGRDDGPGGRQPKGIGRGIDEGGAKGQGGRGRG
GPGGKPSGNRGAGRGRG

SEQ ID NO 102, Glycine max - DNA

ATGGCCAACAATCCGTCACAGCTTCTCCCATCAGAGTTGATTGACCGGTGTATAGGTTCGAAAATT
TGGGTGATAATGAAGGGTGACAAGGAGCTTGTTGGTACTCTTAGAGGCTTTGATGTTTATGTCAAC
ATGGTCCTTGAAGATGTTACTGAATATGAGATCACTGCTGAAGGGAGACGGATAACCAAGCTTGAT
CAGATTTTACTCAATGGAAACAACATTGCCATTTTGGTCCCTGGTGGTTCTCCTGAGTCAGAATGA

SEQ ID NO 103, Glycine max - protein

MANNPSQLLPSELIDRCIGSKIWVIMKGDKELVGTLRGFDVYVNMVLEDVTEYEITAEGRRITKLD
QILLNGNNIAILVPGGSPESE

SEQ ID NO 104, Hordeum vulgare - DNA

ATGTCTTGGGCCGGGCCCGACGAGATCCTCCTCTCCACCTCCCTGGCCGGCTTCTTAGATAAAAAA
CTGATTGTCCTGCTACGAGATGGACGAAAGCTGCTTGGCACTCTCTGCTCATTCGATCAGTTTGCA
AATGTTGTTCTTCAGGGTGCTTGTGAACGAGTGATTGTGGGCGAATTATATTGTGATGTTCCTCTT
GGTTTATATGTGATCCGGGGAGAGAATGTTGTATTAATTGGAGAACTGGATCGTGAGAAGGACGAA
CTCCCTAGCCACATGACTTGTGTTTCAGAGGCTGAAATAAGAACGGCCGAGAAAGCCGAAAAGGAA
GCAAGGGATCTGAAAGGCACAATGAGGAAGAGGATGGAGTTCCTAGACTTCGATTAG

SEQ ID NO 105, Hordeum vulgare - protein

MSWAGPDEILLSTSLAGFLDKKLIVLLRDGRKLLGTLCSFDQFANVVLQGACERVIVGELYCDVPL
GLYVIRGENVVLIGELDREKDELPSHMTCVSEAEIRTAEKAEKEARDLKGTMRKRMEFLDFD

SEQ ID NO 106, Hordeum vulgare - DNA

ATGCTTCCCCTCTCGCTCCTCAAGACCGCCCAGGGGCATCCCATGCTCGTGGAGCTCAAGAACGGC
GAGACCTACAATGGGCACTTGGTCAACTGCGACACGTGGATGAACATCCACCTCCGGGAGGTTATT
TGCACCTCTAAGGATGGTGATAAGTTTTGGAGGATGCCGGAGTGCTATATTCGTGGTAACACAATC
AAGTATCTTCGGGTTCCTGATGAGGTGATTGACAAGGTTCAAGAGGAAACTTCTAAGAGTAGATCA
GATAGGAAGCCGCCAGGTGTTGGCCGCGGAAGAGGAAGAGGAGATATAGGCACTAAACCTGGAGGC
AGAGGCATCGGGCGTGGCCAAGATGATGGCAAAGCGGTGGCCGTGGAAGGGGCGGAATTGGAAGT
AAAGGTGGCAACAAAGGTGGACGTGGCCGTGGGTGA

SEQ ID NO 107, Hordeum vulgare - protein

MLPLSLLKTAQGHPMLVELKNGETYNGHLVNCDTWMNIHLREVICTSKDGDKFWRMPECYIRGNTI
KYLRVPDEVIDKVQEETSKSRSDRKPPGVGRGRGRGDIGTKPGGRGIGRGQDDGKGGGRGRGGIGS
KGGNKGGRGRG

FIGURE 12 (continued)

SEQ ID NO 108, Triticum aestivum - DNA

ATGTCTTGGGCCGGGCCCGACGAGATCCTCCTCTCCACCTCCCTGGCCGGCTTCTTGGATAAAAAA
CTAATTGTCCTACTACGAGATGGACGAAAGCTGCTTGGCACCCTCTGCTCATTCGATCAGTTTGCA
AATGTTGTTCTTCAGGGTGCTTGTGAACGAGTAATTGTGGGCGAATTATATTGTGATGTTCCTCTT
GGTTTATATGTGATCCGGGGAGAGAATGTTGTATTAATTGGAGAACTGGATCGTGAGAAGGACGAA
CTCCCTAGTCACATGACTTGTGTTTCAGAGGCTGAAATAAGAACGGCCGAGAAAGCTGAAAAGGAA
GCAAGGGATCTGAAAGGCACAATGAGGAAGAGGATGGAGTTCCTAGACTTCGATTAG

SEQ ID NO 109, Triticum aestivum - protein

MSWAGPDEILLSTSLAGFLDKKLIVLLRDGRKLLGTLCSFDQFANVVLQGACERVIVGELYCDVPL
GLYVIRGENVVLIGELDREKDELPSHMTCVSEAEIRTAEKAEKEARDLKGTMRKRMEFLDFD

SEQ ID NO 110, Triticum aestivum - DNA

ATGCTTCCCCTCTCGCTCCTCAAGACCGCCCAGGGGCATCCCATGCTCGTGGAGCTCAAAAACGGC
GAGACCTACAATGGGCACTTGGTGAACTGCGACACGTGGATGAACATCCACCTCCGGGAGGTTATT
TGCACCTCCAAGGATGGTGATAAGTTTTGGAGGATGCCGGAGTGCTATATTCGTGGGAACACAATC
AAGTATCTTCGGGTTCCTGATGAGGTGATTGACAAGGTTCAAGAGGAAACTTCTAAGAGTAGATCT
GATAGGAAGCCACCAGGTGTTGGCCGCGGAAGAGGAAGAGGAGATATAGGCACTAAACCTGGGGGC
AGAGGCATCGGACGTGGCCAAGATGATGGCAAAGGCGGTGGCCGCGGAAGGGCGGAATTGGAAGT
AAAGGTGGCAACAAAGGCGGACGTGGTCGTGGGTAA

SEQ ID NO 111, Triticum aestivum - protein

MLPLSLLKTAQGHPMLVELKNGETYNGHLVNCDTWMNIHLREVICTSKDGDKFWRMPECYIRGNTI
KYLRVPDEVIDKVQEETSKSRSDRKPPGVGRGRGRGDIGTKPGGRGIGRGQDDGKGGGRGRGGIGS
KGGNKGGRGRG

SEQ ID NO 112, Triticum aestivum - DNA

ATGCTTCCCCTCTCGCTCCTCAAGACCGCCCAGGGGCATCCCATGCTCGTGGAGCTCAAGAACGGC
GAGACCTACAATGGGCACTTGGTGAACTGCGACACGTGGATGAACATCCACCTCCGGGAGGTTATT
TGCACCTCTAAGGATGGTGATAAGTTTTGGAGGATGCCGGAGTGCTATATTCGTGGTAACACGATC
AAGTATCTTCGGGTTCCTGATGAGGTGATTGACAAGGTTCAAGAGGAAACTTCTAAGAGTAGATCA
GATAGGAAGCCACCAGGTGTTGGTCGTGGAAGAGGAAGAGGAGATATAGGCACTAAACCTGGAGGC
AGAGGCATTGGTCGTGGCCAAGATGATGGCAAAGGCGGTGGCCGTGGAAGGGCGGAATTGGAAGT
AAAGGTGGCAACAAAGGCGGACGTGGTCGTGGGTAA

SEQ ID NO 113, Triticum aestivum - protein

MLPLSLLKTAQGHPMLVELKNGETYNGHLVNCDTWMNIHLREVICTSKDGDKFWRMPECYIRGNTI
KYLRVPDEVIDKVQEETSKSRSDRKPPGVGRGRGRGDIGTKPGGRGIGRGQDDGKGGGRGRGGIGS
KGGNKGGRGRG

FIGURE 12 (continued)

SEQ ID NO 114, Zea mays - DNA atgtcttggtccgcgcccgacgacatcctcctctccacctcactcgcgggcttcctggacaagaaa
cttattgtcctgctaagagatggacggaaacttcttggcaccctctgctcatttgatcagtttgca
aatgttgttcttcagggtgcttgtgaacgagtgattgtaggggacaatattgtgatgttcctctt
ggtctgtatgtgatccggggagagaacgttgttttaatcggagaattggatcacgaaaaggatgaa
ctccccgctcacatgacatgtgttttagaagcagaaattagaaaggctgagaaggcggagcgggaa
gcaagggatctgaaaggcacgatgaggaaacggatggagttcctagacttcgactga

SEQ ID NO 115, Zea mays - protein mswsapddillstslagfldkklivllrdgrkllgtlcsfdqfanvvlqgacervivggqycdvpl
glyvirgenvvligeldhekdelpahmtcvleaeirkaekaereardlkgtmrkrmefldfd

SEQ ID NO 116, Zea mays - DNA

ATGCTTCCCCTCTCGCTCCTCAAGACCGCCCAGGGGCACCCAATGCTCGTGGAGCTGAAGAATGGT
GAGACGTACAACGGGCATCTGGTCAATTGCGACACGTGGATGAACATCCACCTTAGGGAGGTTATT
TGCACCTCAAAGGATGGTGACAAGTTTTGGAGGATGCCAGAGTGTTACATTCGTGGGAACACCATT
AAGTATCTTCGAGTTCCTGATGAGGTGATTGACAAGGTTCAGGAGGAAACTTCCAAAAGCCGGTCA
GATAGGAAGCCACCAGGTGTTGGCCGCGGAAGAGGAAGGGGGACGTTGGTGCTAAACCTGGAGGC
AGAGGCATCGGACGTGGCCAAGATGATGGAGGTAGAGGCAGTGGTGGCCGAGGAAGGGGTGGAGTT
GGTGCCAAAGGTGGTAACAAAGGTGGGGGCCGTGGCCGTGGCTAA

SEQ ID NO 117, Zea mays - protein

MLPLSLLKTAQGHPMLVELKNGETYNGHLVNCDTWMNIHLREVICTSKDGDKFWRMPECYIRGNTI
KYLRVPDEVIDKVQEETSKSRSDRKPPGVGRGRGRGDVGAKPGGRGIGRGQDDGGRGSGGRGRGGV
GAKGGNKGGGRGRG

SEQ ID NO 118, consensus_Lsm_domain-plants

MLPxSLLKTxLGxxMLVxLKxGRxLxGxLxxFDQWMNIVLxEVxExVxxGDxxxxxxxxxxxLxEx
xIRGNxxNIxYLxxxD

SEQ ID NO 119, consensus_Lsm_domain

XXXXXXXLNXAXXXXXXVTVXLKNGXXLXGXVXXFDXFXNLLLXXXXXXXXXXXXXXXXXXXXKX
XXXXXXXXXXXLVYLRGXSIIXIXX

SEQ ID NO 120, AT1G19120_Lsm1a_domain

MSWAAPDDIFFSTSLAAYLDKKLLVLLRDGRKLMGLLRSFDQFANAVLEEAYERVIVGDLYCDIPL
GLYIIRGENVVLIGELD

SEQ ID NO 121, AT3G14080_Lsm1b_domain

MSWAGPEEIYLSTSLASYLDRKLLVLLRDGRKLMGTLRSFDQFANAVLEGACERVIVGEQYCDIPL
GLYVIRGENVVLIGELD

FIGURE 12 (continued)

SEQ ID NO 122, At1g03330_Lsm2_domain

MLFFSYFKDLVGQEVTVELKNDLAIRGTLHSVDQYLNIKLENTRVVDQDKYPHMLSVRNCFIRGSV
VRYVQLPK

SEQ ID NO 123, AT1G21190_Lsm3a_domain

MSVEEDATVREPLDLIRLSIEERIYVKLRSDRELRGKLHAFDQHLNMILGDVEEVITTIEIDDETY
EEIVRTTKRTVPFLFVRG

SEQ ID NO 124, At1g76860_Lsm3b_domain

MSGEEEATVREPLDLIRLSLDERIYVKLRSDRELRGKLHAFDQHLNMILGDVEETITTVEIDDETY
EEIVRTTKRTIEFLFVRG

SEQ ID NO 125, AT5G27720_Lsm4_domain

MLPLSLLKTAQGHPMLVELKNGETYNGHLVNCDTWMNIHLREVICTSKDGDRFWRMPECYIRGNTI
KYLRVPD

SEQ ID NO 126, AT5G48870_Lsm5_domain

MANNPSQLLPSELIDRCIGSKIWVIMKGDKELVGILKGFDVYVNMVLEDVTEYEITAEGRRVTKLD
QILLNGNNIAILVPGG

SEQ ID NO 127, AT3G59810_Lsm6a_domain

MSGVEEKVSGTTKTPADFLKSIRGRPVVVKLNSGVDYRGTLTCLDGYMNIAMEQTEEYVNGQLKNK
YGDAFIRGNNVLYISTVN

SEQ ID NO 128, AT2G43810_Lsm6b_domain

MSGVGEKASGTTKTPADFLKSIRGKPVVVKLNSGVDYRGILTCLDGYMNIAMEQTEEYVNGQLKNT
YGDAFVRGNNVLYISTTK

SEQ ID NO 129, AT2G03870_LMs7_domain

MSGRKETVLDLAKFVDKGVQVKLTGGRQVTGTLKGYDQLLNLVLDEAVEFVRDHDDPLKTTDQTRR
LGLIVCRGTAVMLVSPTD

SEQ ID NO 130, AT1G65700_Lsm8_domain

MAATTGLETLVDQIISVITNDGRNIVGVLKGFDQATNIILDESHERVFSTKEGVQQHVLGLYIIRG
DNIGVIGELD

SEQ ID NO 131, Ms_ABE78228_domain

SFDQFANVVLEGACERVIVGDLYCDVPLGLYVIRGENVVLIGEL

FIGURE 12 (continued)

SEQ ID NO 132, PP_CDS2149like_domain lmgllrsfdqfanavlegacervivgdlycdihlglyvirgenvvligeld

SEQ ID NO 133, Os04g0445800_domain

MSSWAGPDEIFLSTSLAGFLDKKLIVLLRDGRKLLGTLCSFDQFANVVLQGACERVIVGELYCDVP
LGLYVIRGENVVLIGELD

SEQ ID NO 134, Os01g0866700_domain

MAAAAAAAAEEEIAVKEPLDLIRLSLDERIYVKLRSDRELRGKLHAYDQHLNMILGDVEEIVTTV
EIDDETYEEIVRTTKRTIPFLFVRG

SEQ ID NO 135, Os08g0177700_domain

MSGRKETVLDLAKFVDKGVQVKLTGGRQVTGTLKGYDQLLNLVLDEAVEFEREQDDPLKLSGKTRQ
LGLIVCRGTAVMLVSPTD

SEQ ID NO 136, Os01g0256900_domain

MLPLSLLKTAQGHPMLVELKNGETYNGHLVNCDTWMNIHLREVICTSKDGDKFWRMPECYIRGNTI
KYLRVPD

SEQ ID NO 137, Os05g0389300_domain

MSQNNPSQLLPSELIDRCIGSKIWVIMKGDKELVGTLCGFDVYVNMVLEDVTEYEYTAEGRRITKL
DQILLNGNNIAILVPGG

SEQ ID NO 138, Os04g0388900_domain

MSTGGGADKSGGGGGGAVKTPSDFLKSIRGRPVVVKLNSGVDYRGILACLDGYMNIAMEQTEEYVN
GQLKNKYGDAFIRGNNVLYISTSK

SEQ ID NO 139, Os05g0594900_domain

MASAGPGLESLVDQIISVITNDGRNIVGTLRGFDQATNIILDESHERVYSTREGVQQLVLGLYIIR
GDNISVVGEVD

SEQ ID NO 140, Os_CAH67241_domain iflstslagfldkklivllrdgrkllgtlcsfdqfanvvlqgacervivgelycdvplglyvirge
nvvligel

SEQ ID NO 141, LU04FL@62341874_domain

MASGLGLESLVDQTISVITNDGRNIVGNLKGFDQATNIILDESHERVYSTKEGVQQLVLGLYIIRG
DNISVIGELD

FIGURE 12 (continued)

SEQ ID NO 142, BNM01@BN04MC02973_42180507

MGLLRSFDQFANAVIEEAYERVIVGDLYCDIPLGLYIIRGENVVLIGELD

SEQ ID NO 143, BN0204@contig12290_domain

MSWAGPEDIYLSTSLASYLDRKILVLLRDGRKLMGTLRSFDQFANAVLEGACERVIVGEQYCDIPL
GLYVIRGENVVLIGDLD

SEQ ID NO 144, BN0204@contig30411_domain

MSWAGPEDIYLSTSLASYLDRKILVLLRDGRKLMGTLRSFDQFANAVLEGACERVIVGEQYCDIPL
GLYVIRGENVVLIGDLD

SEQ ID NO 145, BN04FL@41982578_domain

MLPLSLLKTAQGHPMLVELKNGETYNGHLVNCDTWMNIHLREVICTSKDGDRFWRMPECYIRGNTI
KYLRVPD

SEQ ID NO 146, BN04FL@42120216_domain

MLPLSLLKTAQGHPMLVELKNGETYNGHLVNCDTWMNIHLREVICTSKDGDRFWRMPECYIRGNTI
KYLRVPD

SEQ ID NO 147, BN04FL@42952553_domain

MLPLSLLKTAQGHPMLVELKNGETYNGHLVNCDTWMNIHLREVICTSKDGDRFWRMPECYIRGNTI
KYLRVPD

SEQ ID NO 148, GM04FL@GM06LC725_domain

MLPLSLLKTAQGHPMLVELKNGETYNGHLVNCDTWMNIHLREVICTSKDGDRFWRMPECYIRGNTI
KYLRVPD

SEQ ID NO 149, GM04FL@GM06LC5469_domain

MLPLSLLKTAQGHPMLVELKNGETYNGHLVNCDTWMNIHLREVICTSKDGDRFWRMPECYIRGNTI
KYLRVPD

SEQ ID NO 150, GM04FL@GM06MC03669_domain

MLPLSLLKTAQGHPMLVELKNGETYNGHLVNCDTWMNIHLREVICTSKDGDRFWRMPECYIRGNTI
KYLRVPD

SEQ ID NO 151, GM04FL@GM02LC15807_domain

MANNPSQLLPSELIDRCIGSKIWVIMKGDKELVGTLRGFDVYVNMVLEDVTEYEITAEGRRITKLD
QILLNGNNIAILVPGG

FIGURE 12 (continued)

SEQ ID NO 152, HV04FL@63122459_domain

MSWAGPDEILLSTSLAGFLDKKLIVLLRDGRKLLGTLCSFDQFANVVLQGACERVIVGELYCDVPL
GLYVIRGENVVLIGELD

SEQ ID NO 153, HV04FL@62658793_domain

MLPLSLLKTAQGHPMLVELKNGETYNGHLVNCDTWMNIHLREVICTSKDGDKFWRMPECYIRGNTI
KYLRVPD

SEQ ID NO 154, TA0704@contig16414_domain
MSWAGPDEILLSTSLAGFLDKKLIVLLRDGRKLLGTLCSFDQFANVVLQGACERVIVGELYCDVPL
GLYVIRGENVVLIGELD

SEQ ID NO 155, TA04FL@TA02LC45139_domain

MLPLSLLKTAQGHPMLVELKNGETYNGHLVNCDTWMNIHLREVICTSKDGDKFWRMPECYIRGNTI
KYLRVPD

SEQ ID NO 156, TA04FL@TA02LC24263_domain

MLPLSLLKTAQGHPMLVELKNGETYNGHLVNCDTWMNIHLREVICTSKDGDKFWRMPECYIRGNTI
KYLRVPD

SEQ ID NO 157, ZM0404@contig12257_domain

MSWSAPDDILLSTSLAGFLDKKLIVLLRDGRKLLGTLCSFDQFANVVLQGACERVIVGGQYCDVPL
GLYVIRGENVVLIGELD

SEQ ID NO 158, ZM04FL@ZM06LC6366_domain

MLPLSLLKTAQGHPMLVELKNGETYNGHLVNCDTWMNIHLREVICTSKDGDKFWRMPECYIRGNTI
KYLRVPD

SEQ ID NO 159, Motif 1

GTLXSFDQFANVVLXGACERVIVGELYCDVPLGLYVIRGENVVLIG

SEQ ID NO 160, Motif 2

KAEREARDLKGTMRKRMEFLDFD

SEQ ID NO 161, PromoterWSI18

GCTTGAGTCATAGGGAGAAAACAAATCGATCATATTTGACTCTTTTCCCTCCATCTCTCTTACCGG
CAAAAAAGTAGTACTGGTTTATATGTAAAGTAAGATTCTTTAATTATGTGAGATCCGGCTTAATG
CTTTTCTTTTGTCACATATACTGCATTGCAACAATTGCCATATATTCACTTCTGCCATCCCATTAT
ATAGCAACTCAAGAATGGATTGATATATCCCCTATTACTAATCTAGACATGTTAAGGCTGAGTTGG

FIGURE 12 (continued)

```
GCAGTCCATCTTCCCAACCCACCACCTTCGTTTTTCGCGCACATACTTTTCAAACTACTAAATGGT
GTGTTTTTAAAAATATTTTCAATACAAAAGTTGCTTTAAAAAATTATATTGATCCATTTTTTTAA
AAAAAATAGCTAATACTTAATTAATCACGTGTTAAAAGACCGCTCCGTTTTGCGTGCAGGAGGGAT
AGGTTCACATCCTGCATTACCGAACACAGCCTAAATCTTGTTGTCTAGATTCGTAGTACTGGATAT
ATTAAATCATGTTCTAAGTTACTATATACTGAGATGAATAGAATAAGTAAAATTAGACCCACCTTA
AGTCTTGATGAAGTTACTACTAGCTGCGTTTGGGAGGACTTCCCAAAAAAAAAGTATTAGCCATT
AGCACGTGATTAATTAAGTACTAGTTTAAAAAACTTAAAAAATAAATTAATATGATTCTCTTAAGT
AACTCTCCTATAGAAAACTTTTACAAAATTACACCGTTTAATAGTTTGGAAAATATGTCAGTAAAA
AATAAGAGAGTAGAAGTTATGAAAGTTAGAAAAGAATTGTTTTAGTAGTATACAGTTATAAACTA
TTCCCTCTGTTCTAAAACATAAGGGATTATGGATGGATTCGACATGTACCAGTACCATGAATCGAA
TCCAGACAAGTTTTTTATGCATATTTATTCTACTATAATATATCACATCTGCTCTAAATATCTTAT
ATTTCGAGGTGGAGACTGTCGCTATGTTTTTCTGCCCGTTGCTAAGCACACGCCACCCCCGATGCG
GGGACGCCTCTGGCCTTCTTGCCACGATAATTGAATGGAACTTCCACATTCAGATTCGATAGGTGA
CCGTCGACTCCAAGTGCTTTGCACAAAACAACTCCGGCCTCCCGGCCACCAGTCACACGACTCACG
GCACTACCACCCCTGACTCCCTGAGGCGGACCTGCCACTGTTCTGCATGCAAGCTATCTAAAATT
CTGAAGCAAAGAAAGCACAGCACATGCTCCGGGACACGCGCCACCCGGCGGAAAAGGGCTCGGTGT
GGCGATCTCACAGCCGCATATCGCATTTCACAAGCCGCCCATCTCCACCGGCTTCACGAGGCTCAT
CGCGGCACGACCGCGCACGGAACGCACGCGGCCGACCCGCGCGCCTCGATGCGCGAGCCCATCCGC
CGCGTCCTCCCTTTGCCTTTGCCGCTATCCTCTCGGTCGTATCCCGTTTCTCTGTCTTTTGCTCCC
CGGCGCGCGCCAGTTCGGAGTACCAGCGAAACCCGGACACCTGGTACACCTCCGCCGGCCACAACG
CGTGTCCCCCCTACGTGGCCGCGCAGCACATGCCCATGCGCGACACGTGCACCTCCTCATCCAAAC
TCTCAAGTCTCAACGGTCCTATAAATGCACGGATAGCCTCAAGCTGCTCGTCACAAGGCAAGAGGC
AAGAGGCAAGAGCATCCGTATTAACCAGCCTTTTGAGACTTGAGAGTGTGTGTGACTCGATCCAGC
GTAGTTTCAGTTCGTGTGTTGGTGAGTGATTCCAGCCAAGTTTGCG
```

SEQ ID NO 162, primer_sense

```
GGGGACAAGTTTGTACAAAAAAGCAGGCTTAAACAATGTCTTGGGCTGCTCCT
```

SEQ ID NO 163, primer_antisense

```
GGGGACCACTTTGTACAAGAAAGCTGGGTTTTCTACAATGCTGCAACACA
```

SEQ ID NO: 164, Rice WSI18 promoter variant
```
GCTTGAGTCATAGGGAGAAAACAAATCGATCATATTTGACTCTTTTCCCTCCATCTCTCTTACCGG
CAAAAAAGTAGTACTGGTTTATATGTAAAGTAAGATTCTTTAATTATGTGAGATCCGGCTTAATG
CTTTTCTTTTGTCACATATACTGCATTGCAACAATTGCCATATATTCACTTCTGCCATCCCATTAT
ATAGCAACTCAAGAATGGATTGATATATCCCCTATTACTAATCTAGACATGTTAAGGCTGAGTTGG
GCAGTCCATCTTCCCAACCCACCACCTTCGTTTTTCGCGCACATACTTTTCAAACTACTAAATGGT
GTGTTTTTAAAAATATTTTCAATACAAAAGTTGCTTTAAAAAATTATATTGATCCATTTTTTTAA
AAAAAATAGCTAATACTTAATTAATCACGTGTTAAAAGACCGCTCCGTTTTGCGTGCAGGAGGGAT
AGGTTCACATCCTGCATTACCGAACACAGCCTAAATCTTGTTGTCTAGATTCGTAGTACTGGATAT
ATTAAATCATGTTCTAAGTTACTATATACTGAGATGAATAGAATAAGTAAAATTAGACCCACCTTA
AGTCTTGATGAAGTTACTACTAGCTGCGTTTGGGAGGACTTCCCAAAAAAAAAGTATTAGCCATT
AGCACGTGATTAATTAAGTACTAGTTTAAAAAACTTAAAAAATAAATTAATATGATTCTCTTAAGT
AACTCTCCTATAGAAAACTTTTACAAAATTACACCGTTTAATAGTTTGGAAAATATGTCAGTAAAA
AATAAGAGAGTAGAAGTTATGAAAGTTAGAAAAGAATTGTTTTAGTAGTATACAGTTATAAACTA
```

FIGURE 12 (continued)

```
TTCCCTCTGTTCTAAAACATAAGGGATTATGGATGGATTCGACATGTACCAGTACCATGAATCGAA
TCCAGACAAGTTTTTTATGCATATTTATTCTACTATAATATATCACATCTGCTCTAAATATCTTAT
ATTTCGAGGTGGAGACTGTCGCTATGTTTTTCTGCCCGTTGCTAAGCACACGCCACCCCCGATGCG
GGGACGCCTCTGGCCTTCTTGCCACGATAATTGAATGGAACTTCCACATTCAGATTCGATAGGTGA
CCGTCGACTCCAAGTGCTTTGCACAAAACAACTCCGGCCTCCCGGCCACCAGTCACACGACTCACG
GCACTACCACCCCTGACTCCCTGAGGCGGACCTGCCACTGTTCTGCATGCGAAGCTATCTAAAATT
CTGAAGCAAAGAAAGCACAGCACATGCTCCGGGACACGCGCCACCCGGCGGAAAAGGGCTCGGTGT
GGCGATCTCACAGCCGCATATCGCATTTCACAAGCCGCCCATCTCCACCGGCTTCACGAGGCTCAT
CGCGGCACGACCGCGCACGGAACGCACGCGGCCGACCCGCGCGCCTCGATGCGCGAGCCCATCCGC
CGCGTCCTCCCTTTGCCTTTGCCGCTATCCTCTCGGTCGTATCCCGTTTCTCTGTCTTTTGCTCCC
CGGCGCGCGCCAGTTCGGAGTACCAGCGAAACCCGGACACCTGGTACACCTCCGCCGGCCACAACG
CGTGTCCCCCTACGTGGCCGCGCAGCACATGCCCATGCGCGACACGTGCACCTCCTCATCCAAACT
CTCAAGTCTCAACGGTCCTATAAATGCACGGATAGCCTCAAGCTGCTCGTCACAAGGCAAGAGGCA
AGAGGCAAGAGCATCCGTATTAACCAGCCTTTTGAGACTTGAGAGTGTGTGTGACTCGATCCAGCG
TAGTTTCAGTTCGTGTGTTGGTGAGTGATTCCAGCCAAGTTTGCG
```

```
SEQID181  FK------FPHKIQATAIIYFKRFYLQWSVMEHQPKHIMLTCVYASCKVEENHVSAEELG
SEQID189  FK------FPHKIQATAIIYFKRFYLQWSVMEHHPKHNMLTCVYASCKVEENHVSAEELG
SEQID177  FK------FPHKIQATAIIYFKRFYLQWSVMEHHPKHIMLTCIYSSCKVEENHVSAEELG
SEQID183  FK------FPHKIQATAIIYFKRFYLQWSVMEHHPKHIMLTCVYASCKVEENHVSAEELG
SEQID166  FA------FPHKIQATALQYFKRFYLQWSVMQHHPKEIMLTCVYAACKIEENHVSAEEIG
SEQID173  FA------FPHKIQATALQYFKRFYLQWSVMQHHPKEIMLTCVYAACKIEENHVSAEEIG
SEQID175  FY------FPHKIQATALLYFKRFYLQWSVMEHDPKHVMLTCIYAACKIEENHVSAEELG
SEQID179  FK------FPRKIQATALIYFKRFYLLWSVMEHHPKDIMLTCIYAACKAEENHVSAEELG
SEQID187  FK------FPRKIQATALIYFKRFYLQWSVMEHHPKDIMLTCIYASCKIEENHVSAEELG
SEQID185  FG------FPQKIQGTAIIYFKRFYLQWSVMEHHPKNIMLTCIYASCKVEEFNVSINQFV
SEQID193  FEPT----MPKCVVGTAFHYFKRFYLNNSPMDYHPKEILATCVFVACKVEEFNVSSPQFV
SEQID195  FKPA----MPRSVVGTACMYFKRFYLNNSVMEYHPRIIMLTCAFLACKVDEFNVSSPQFV
SEQID191  FA------LPRKVKNTAVMLFKRFAVDCGTHAQSLKIMMLTSVYVACKVEESYISAEEFC
SEQID197  NASVSRLRRESKVPATAALLYRRFFLSNSVLLYDPKVIMVAAAFLGSKVEDATADVRYLE
                  :              ::         **  ::::::    :       ..

SEQID181  ------KGIQQD------HQIILNNEMILLKTLDFDLIVYAPYRSIEGFIDDLEDFCRAGN----
SEQID189  ------KGIQQD------HQIILNNEMILLKTLDFDLIVYAPYRSIEGFIDDLEDFCRAGN----
SEQID177  ------KGIQQD------HQIILNNEMIVLKSLDFDLIVYAPYRSIEGFVDDMEDFCRAGN----
SEQID183  ------KGIQQD------HQIILNNEMIVLKSLDFDLIVYAPYRSIEGFIDDMDDFCRAGN----
SEQID166  ------KGINQD------HRIILKYEMAVLQSLEFDLIVYAPYRAIEGFVNNMEEFLQARD----
SEQID173  ------KGINQD------HRIILKYEMAVLQSLEFDLIVYAPYRAIEGFVNNMEEFLQARD----
SEQID175  ------KGINQD------HQMILNYEMIVYQSLEFDLIVYAPYRSVEGFVADIEEFCHPTD----
SEQID179  ------KGISQD------HHVILNNEMLVFQSLGFDLIAYAPYRALEGFISNLEEFCGAQDN---
SEQID187  ------KGIGQD------HHVILNNEMLVFQSLGFDLIVYAPYRALESFISDLEEFCGAKDE---
SEQID185  ------KGIGQD------HQVILNNEMLVLQSLGFDLIVYAPYRSIEGFVDDIEDFCQAND---
SEQID193  ------KGIQQD------HQVILNNEMLVLQSLGFDLIVYAPYRSIEGFVDDIEDFCQAND----
SEQID195  ------NNIKGD------RNKATDIVLSNELLIGQLNYYLTIHNPFRPIEGFLIDIKTRS-NMQ----
SEQID191  GNLRESPLGQEKALEQILEYELLLIQQLNFHLIVHNPYRPFEGFLIDLKTRYPILE----
SEQID197  KGVRED----PSRVLAAEVTFLSGLKFRLVCYGATRPLDGFLMDVEDGGCKGA----
SEQID197  EGTALMN--APVSQAEIIPAELNLLSGTYFDLLCFHPYKTVLALTEDLRTYLKSDKGQAL
                            *                                     *
```

FIGURE 14 (continued)

```
SEQID181  ----------------------------------GPFQRLKELRQAAISHVDKMMLTDAPLLYTPGQLALAALH
SEQID189  ----------------------------------GPFQRLKELRQAAISRVDKMMLTDAPLLYTPGQLALAALH
SEQID177  ----------------------------------GEHQRLQDLRQTAISQVDKMMLTDAPLLYTPGQLALAALH
SEQID183  ----------------------------------GAHQRLKDLHQTANSEVDTMMLTDAPLLYTPGQLALAALY
SEQID166  ----------------------------------DEIQKLEYSAEFAQRGDSRSR-----------------
SEQID173  ----------------------------------DEIQKLESLLKGATAEADKVMLTDAPLLFPPGQLALASLR
SEQID175  ----------------------------------ENIEKLK---EIAVAEVDKIMLTDAPVMFPPGQLALAALQ
SEQID179  ----------------------------------DQLLALKGALDTARIEADKIMRSDGPLLFPPGQLALTALH
SEQID187  ----------------------------------DQLVALKGSLDTARIEADKIMRSDGPLLFPPGQLALTALH
SEQID185  ----------------------------------QLEMLKDLKETAKLEVDRILLTDAPLLFPPGQLALAALR
SEQID193  ----------------------------------NPDRLRPHIDSFIDSTYYSDACLLHTPSQIALAAVL
SEQID195  ----------------------------------NPEILRKTADDFLNRIALTDAYLLYTPSQIALTAIL
SEQID191  ----------------------------------TSKQLIECRKKALDIVDRLMLTDAPLIRPPGQIALCALR
SEQID197  VSWPPTTAADDDDVNVPAPLLSGQDLKPMYEAARALVDDCVVSDIPLLYTPGQVGLAALM

SEQID181  KSNDLLRV-----------VDFERYLEIIFSRQ-HSDCPIEQFVQSINEINYLVD
SEQID189  KSNDLLRV-----------VNFERYLETIFSRQ-HSDCPVEQFVQSINTINYLVD
SEQID177  KSNDMHKI-----------LNFERYLESVFSRQ-HSDCPIEQFVGSINMINYLVE
SEQID183  KSNSALSV-----------LDFERYLESVFSRQ-HFDCPVEQFIQIISSINHLVS
SEQID166  -----------------------------------------------
SEQID173  IANGVLGV-----------IDFDRYLENIVSQP-NSEHTTSELTKLLDNIEYLVK
SEQID175  SANEMHRV-----------LDFERYLESVLSRQ-NSAHMISEISESLHAVEKWVR
SEQID179  RADAAHGI-----------FDFERYLRSVLSHHDQPGHAISELTDSINVIDSLVG
SEQID187  RANAAHSI-----------FDFERYLRSVLSHY-EPAHAISELAGSINAIDSLVG
SEQID185  RSNEVHGV-----------LDFERYLGSIISRQ-QSMHTSSELIESLNLIYSLLV
SEQID193  HAASREQE-----------NLDSYVTDLLFVS---AREKLPGLIDAVRKIRIMVK
SEQID195  SSASRAGI-----------TMESYLSESLMLKE--NRTCLSQLLDIMKSMRNLVK
SEQID191  RAARECGA-----------SELEKYCEDVGARGTTKAPRGAKLKEILDDIESHVD
SEQID197  VAQAELLVRSRGNGASNQKSRIPQIDLEGYVRQRFDTDETREISMDTFLATLRTLQTQLQ
```

FIGURE 14 (continued)

| | | |
|---|---|---|
| SEQID181 | QLNIP--------- | ----------TVKDMRHVDRKLKHCWDPSS--HDEHNKKEKKSKHKSKRTSTD |
| SEQID189 | QLNIP--------- | ----------TVKDMRHVERKLKHCWDSSS--HYEP--------------- |
| SEQID177 | QLKIP--------- | ----------TPKDMRHIDRKLKHCLDPSS--QDEHKKKEKKSKHHSKRAANEA |
| SEQID183 | QLQLP--------- | ----------GTKEMRHADRKLKHCLDPSSSSHDDHKKEKKSKHHSKRTASDA |
| SEQID166 | -------------- | ---------------------------------------------------- |
| SEQID173 | NYKCP--------- | ----------SEKDMKHINRKLKSCLGHSSHDESKKREKRSKHKSHRSSNDTP |
| SEQID175 | KYSFP--------- | ----------TDKDMKHINRKLKSCWGHN-SHDDNKKREKKSKHKSHKSSNEMQ |
| SEQID179 | KLLTP--------- | ----------TSKDVKHIDRKLKSCLDPGSHDKSKKKRKHRSKDSSNEVTDIS-- |
| SEQID187 | KLLTP--------- | ----------TSKDVKHVDRKLKSCLDPGF--------------------- |
| SEQID185 | KLKMP--------- | ----------SSDDMKPIDRKLRYCLDPSLQDKKREKRSKHKSKKSSSEKHGL |
| SEQID193 | QYQQP--------- | ----------DREKVKAIEKKLDKCRNQANNPDSELYKERLRRLYTDEDDMPAE |
| SEQID195 | KYEPP--------- | ----------RSEEVAVLKQKLERCHSAELALNVITKKRKG-----YEDDDYVS |
| SEQID191 | EGVEP--------- | ----------DAAVVKEIDKKLKLWRAKYLAKTPAADDAGDAQKAAKRKSEQS |
| SEQID197 | GLREGQLGCYNNPSVIDMQALKAIHKKLKKVRAWGTSGSGGKSEKKKKRGSPAGGTAN |

| | |
|---|---|
| SEQID181 | AQL---------- |
| SEQID189 | ------------ |
| SEQID177 | QLDS--------- |
| SEQID183 | QLNS--------- |
| SEQID166 | ------------ |
| SEQID173 | NGAPPPIG----- |
| SEQID175 | NGPGLT------- |
| SEQID179 | ------------ |
| SEQID187 | PSSTPS------- |
| SEQID185 | DASFHIADVSSDTSAMNISQ |
| SEQID193 | KKSKHEEEEWTDDDLVESL- |
| SEQID195 | RQDMIAAEEDALG------- |
| SEQID191 | AVDSGEPERKKMKASGAQ-- |
| SEQID197 | ------------ |

FIGURE 14 (continued)

SEQ ID NO: 165, truncated AtCycH, coding sequence, Arabidopsis thaliana
ATGGCGGATTTTCAGACATCAACACAACGGGCCAAGTGGATTTTCACTCCCCAGAAACTGGCAGAG
AGATATAAAGCTGCTAACCAGAGGGCAGTGCAAATGCTGGAGAAGTGTGGAACAACTCAAGTTGAA
GTAGATGCTAGTGGATCACTAACATATCCTAAAGATAAAGTTGGTTCAGGAGATCAAGCTGATAAG
AAGCTTAAGCCTTTGAGTGCTGATGAAGAAGGTTCATGAGAGCATTTTATGAGGCAAAGGTCCAA
GAAGTGTGCAGTGCCTTTGCATTTCCTCACAAGATTCAGGCAACAGCCCTCCAATACTTTAAGAGA
TTTTATCTGCAATGGTCTGTTATGCAACATCATCCAAAAGAGATAATGTTAACCTGTGTGTATGCA
GCTTGTAAAATAGAGGAGAATCATGTATCTGCTGAGGAAATTGGGAAAGGGATTAACCAAGATCAC
CGAATAATTCTCAAGTACGAGATGGCTGTTCTTCAGAGTTTGGAATTTGATCTGATTGTTTATGCA
CCGTATCGTGCAATCGAAGGTTTTGTCAACAACATGGAGGAATTTCTTCAAGCTAGAGATGATGAA
ATCCAAAAACTAGAGTATTCTGCAGAGTTTGCTCAAGGGGCGACAGCAGAAGCCGATAAAGTTAT
GCTCACAGATGCTCCACTCCTCTTTCCTCCTGGCCAGTTGGCATTGGCGTCGTTACGTATTGCAAA
TGGGGTTCTTGGAGTGATTGACTTTGATAGGTACCTAGAGAACATTGTTTCTCAACCGAACTCTGA
GCACACGACTTCAGAGCTTACAAAGTTACTTGATAACATCGAATATTGGTAAAGAACTACAAGTG
CCCAAGTGAAAAGGACATGAAGCATATCAACCGGAAGCTAAAATCTTGTCTAGGACATAGTTCTTC
ACATGACGAGAGTAAGAAACGGGAGAAGAGATCAAAACACAAGTCCCATAG

SEQ ID NO: 166, truncated AtCycH, Arabidopsis thaliana
MADFQTSTQRAKWIFTPQKLAERYKAANQRAVQMLEKCGTTQVEVDASGSLTYPKDKVGSGDQADK
KLKPLSADEERFMRAFYEAKVQEVCSAFAFPHKIQATALQYFKRFYLQWSVMQHHPKEIMLTCVYA
ACKIEENHVSAEEIGKGINQDHRIILKYEMAVLQSLEFDLIVYAPYRAIEGFVNNMEEFLQARDDE
IQKLEYSAEFAQRGDSRSR

SEQ ID NO: 167, prm02688 (fwd)
GGGGACAAGTTTGTACAAAAAAGCAGGCTTCACAATGGCGGATTTTCAGACATC

SEQ ID NO: 168, prm02689 (rev)
ggggaccactttgtacaagaaagctgggtaaactcaacctatgggtggc

SEQ ID NO: 169, conserved motif
(L/V/I)(Q/R)(E/D)VCXAF

SEQ ID NO: 170, Seed-specific promoter
GGTCAGCCAATACATTGATCCGTTGCCAATCATGCAAAGTATTTTGGCTGTGGCCGAGTGCCGGAA
TTGATAATTGTGTTCTGACTAAATTAAATGACCAGAAGTCGCTATCTTCCAATGTATCCGAAACCT
GGATTAAACAATCCTGTTCTGTTCTCTAGCCCCTCCTGCATGGCCGGATTGTTTTTTTGACATGTT
TTCTTGACTGAGGCCTGTTTGTTCTAAACTTTTTCTTCAAACTTTTAACTTTTTCATCACATCAGA
ACTTTTCTACACATATAAACTTTTAACTTTTCCGTCACATCGTTCCAATTTCAATCAAACTTTCAA
TTTTGGCGTGAACTAAACACACCCTGAGTCTTTTATTGCTCCTCCGTACGGGTTGGCTGGTTGAGA
ATAGGTATTTTCAGAGAGAAAATCTAGATATTGGGAGGAACTTGGCATGAATGGCCACTATATTTA
GAGCAATTCTACGGTCCTTGAGGAGGTACCATGAGGTACCAAAATTTTAGTGTAAATTTTAGTATC
TCATTATAACTAGGTATTATGAGGTACCAAATTTACAATAGAAAAAATAGTACTTCATGGTACTTT
CTTAAGTACCGTAAAATTGCTCCTATATTTAAGGGGATGTTTATATCTATCCATATCCATAATTTG
ATTTTGATAAGAAAAATGTGAGCACACCAAGCATGTCCATGACCTTGCACTCTTGGCTCACTCGT
CAACTGTGAAGAACCTCAAAAATGCTCAATATAGCTACAGGTGCCTGAAAAATAACTTTAAAGTT
TGAACATCGATTTCACTAAACAACAATTATTATCTCCCTCTGAAAGATGATAGTTTAGAACTCTA
GAATCATTGTCGGCGGAGAAAGTAAATTATTTTCCCCAAATTTCCAGCTATGAAAAACCCTCACC

FIGURE 17

```
AAACACCATCAAACAAGAGTTCACCAAACCGCCCATGCGGCCATGCTGTCACGCAACGCACCGCAT
TGCCTGATGGCCGCTCGATGCATGCATGCTTCCCCGTGCACATATCCGACAGACGCGCCGTGTCAG
CGAGCTCCTCGACCGACCTGTGTAGCCCATGCAAGCATCCACCCCCGCCACGTACACCCCTCCTC
CTCCCTACGTGTCACCGCTCTCTCCACCTATATATGCCCACCTGGCCCCTCTCCTCCCATCTCCAC
TTCACCCGATCGCTTCTTCTTCTTCTTCGTTGCATTCATCTTGCTAGC
```

SEQ ID NO: 171, WSI18 Promoter
```
GCTTGAGTCATAGGGAGAAAACAAATCGATCATATTTGACTCTTTTCCCTCCATCTCTCTTACCGG
CAAAAAAGTAGTACTGGTTTATATGTAAAGTAAGATTCTTTAATTATGTGAGATCCGGCTTAATG
CTTTTCTTTTGTCACATATACTGCATTGCAACAATTGCCATATATTCACTTCTGCCATCCCATTAT
ATAGCAACTCAAGAATGGATTGATATATCCCCTATTACTAATCTAGACATGTTAAGGCTGAGTTGG
GCAGTCCATCTTCCCAACCCACCACCTTCGTTTTCGCGCACATACTTTTCAAACTACTAAATGGT
GTGTTTTTAAAAATATTTTCAATACAAAAGTTGCTTTAAAAAATTATATTGATCCATTTTTTTAA
AAAAAATAGCTAATACTTAATTAATCACGTGTTAAAAGACCGCTCCGTTTTGCGTGCAGGAGGGAT
AGGTTCACATCCTGCATTACCGAACACAGCCTAAATCTTGTTGTCTAGATTCGTAGTACTGGATAT
ATTAAATCATGTTCTAAGTTACTATATACTGAGATGAATAGAATAAGTAAAATTAGACCCACCTTA
AGTCTTGATGAAGTTACTACTAGCTGCGTTTGGGAGGACTTCCCAAAAAAAAAGTATTAGCCATT
AGCACGTGATTAATTAAGTACTAGTTTAAAAAACTTAAAAAATAAATTAATATGATTCTCTTAAGT
AACTCTCCTATAGAAAACTTTTACAAAATTACACCGTTTAATAGTTTGGAAAATATGTCAGTAAAA
AATAAGAGAGTAGAAGTTATGAAAGTTAGAAAAAGAATTGTTTAGTAGTATACAGTTATAAACTA
TTCCCTCTGTTCTAAAACATAAGGGATTATGGATGGATTCGACATGTACCAGTACCATGAATCGAA
TCCAGACAAGTTTTTATGCATATTTATTCTACTATAATATATCACATCTGCTCTAAATATCTTAT
ATTTCGAGGTGGAGACTGTCGCTATGTTTTCTGCCCGTTGCTAAGCACACGCCACCCCCGATGCG
GGGACGCCTCTGGCCTTCTTGCCACGATAATTGAATGGAACTTCCACATTCAGATTCGATAGGTGA
CCGTCGACTCCAAGTGCTTTGCACAAAACAACTCCGGCCTCCCGGCCACCAGTCACACGACTCACG
GCACTACCACCCCTGACTCCTGAGGCGGACCTGCCACTGTTCTGCATGCGAAGCTATCTAAAATT
CTGAAGCAAAGAAAGCACAGCACATGCTCCGGGACACGCGCCACCCGGCGGAAAAGGGCTCGGTGT
GGCGATCTCACAGCCGCATATCGCATTTCACAAGCCGCCCATCTCCACCGGCTTCACGAGGCTCAT
CGCGGCACGACCGCGCACGGAACGCACGCGGCCGACCCGCGCGCCTCGATGCGCGAGCCCATCCGC
CGCGTCCTCCCTTTGCCTTTGCCGCTATCCTCTCGGTCGTATCCCGTTTCTCTGTCTTTTGCTCCC
CGGCGCGCGCCAGTTCGGAGTACCAGCGAAACCCGGACACCTGGTACACCTCCGCCGGCCACAACG
CGTGTCCCCCTACGTGGCCGCGCAGCACATGCCCATGCGCGACACGTGCACCTCCTCATCCAAAC
TCTCAAGTCTCAACGGTCCTATAAATGCACGGATAGCCTCAAGCTGCTCGTCACAAGGCAAGAGGC
AAGAGGCAAGAGCATCCGTATTAACCAGCCTTTTGAGACTTGAGAGTGTGTGTGACTCGATCCAGC
GTAGTTTCAGTTCGTGTGTTGGTGAGTGATTCCAGCCAAGTTTGCG
```

SEQ ID NO: 172, AB051072.1, Arabidopsis thaliana AtCycH1 mRNA for cyclin H, complete cds
```
ATGGCGGATTTTCAGACATCAACACAACGGGCCAAGTGGATTTTCACTCCCCAGAAACTGGCAGAG
AGATATAAAGCTGCTAACCAGAGGGCAGTGCAAATGCTGGAGAAGTGTGGAACAACTCAAGTTGAA
GTAGATGCTAGTGGATCACTAACATATCCTAAAGATAAAGTTGGTTCAGGAGATCAAGCTGATAAG
AAGCTTAAGCCTTTGAGTGCTGATGAAGAAAGGTTCATGAGAGCATTTTATGAGGCAAAGGTCCAA
GAAGTGTGCAGTGCCTTTGCATTTCCTCACAAGATTCAGGCAACAGCCCTCCAATACTTTAAGAGA
TTTTATCTGCAATGGTCTGTTATGCAACATCATCCAAAAGAGATAATGTTAACCTGTGTGTATGCA
GCTTGTAAAATAGAGGAGAATCATGTATCTGCTGAGGAAATTGGGAAGGGATTAACCAAGATCAC
CGAATAATTCTCAAGTACGAGATGGCTGTTCTTCAGAGTTTGGAATTTGATCTGATTGTTTATGCA
CCGTATCGTGCAATCGAAGGTTTTGTCAACAACATGGAGGAATTTCTTCAAGCTAGAGATGATGAA
ATCCAAAAACTAGAGAGTTTGCTCAAAGGGGCGACAGCAGAAGCCGATAAAGTTATGCTCACAGAT
```

```
GCTCCACTCCTCTTTCCTCCTGGCCAGTTGGCATTGGCGTCGTTACGTATTGCAAATGGGGTTCTT
GGAGTGATTGACTTTGATAGGTACCTAGAGAACATTGTTTCTCAACCGAACTCTGAGCACACGACT
TCAGAGCTTACAAAGTTACTTGATAACATCGAATATTTGGTAAAGAACTACAAGTGCCCAAGTGAA
AAGGACATGAAGCATATCAACCGGAAGCTAAAATCTTGTCTAGGACATAGTTCTTCACATGACGAG
AGTAAGAAACGGGAGAAGAGATCAAAACACAAGTCCCATAGGAGCTCCAATGATACACCAAACGGG
GCACCGCCACCCATAGGTTGA
```

SEQ ID NO: 173, BAB72144.1, cyclin H [Arabidopsis thaliana]
```
MADFQTSTQRAKWIFTPQKLAERYKAANQRAVQMLEKCGTTQVEVDASGSLTYPKDKVGSGDQADK
KLKPLSADEERFMRAFYEAKVQEVCSAFAFPHKIQATALQYFKRFYLQWSVMQHHPKEIMLTCVYA
ACKIEENHVSAEEIGKGINQDHRIILKYEMAVLQSLEFDLIVYAPYRAIEGFVNNMEEFLQARDDE
IQKLESLLKGATAEADKVMLTDAPLLFPPGQLALASLRIANGVLGVIDFDRYLENIVSQPNSEHTT
SELTKLLDNIEYLVKNYKCPSEKDMKHINRKLKSCLGHSSSHDESKKREKRSKHKSHRSSNDTPNG
APPPIG
```

SEQ ID NO: 174, AF092743 Populus tremula x Populus tremuloides CAK associated cyclinH homolog (cycH) mRNA, complete cds
```
AATAATTCGAATATAAATTCTCTCTGATCAAAGAACAAGTAACACAACACGCTGATCACTGAGATA
GGGTTACCGAGTCACCCATGGCCGATTTCCAATCCTCAAGTCACAAAGCCAAGTGGATCTTCACCC
CTCAACAGTTGGCCGAGAAGTATAAAGCTACTAATAATAGAGCGAAACAAATGTTAGAGAAGTATG
GAACGACAAGAATGAGAGTAGATGTTGATGGGTCATTGTCATATCCAGAACCTCAAGTTAACATGA
CAGAGAATGCTGATAAGCATTCTCGTTCAAAACCAATAAGTGTCGAGGAAGAACAATTTATGCGAG
TATACTATGAGTATAAACTTCGAGAAGTGTGTAGTGCATTCTATTTTCCTCATAAAATTCAGGCAA
CTGCACTCCTATACTTTAAAAGGTTTTATCTTCAATGGTCAGTCATGGAGCATGATCCAAAACATG
TAATGTTAACCTGCATCTATGCAGCATGCAAGATAGAAGAAATCATGTGTCTGCGGAGGAGCTTG
GTAAGGGGATTTCACAGGATCATCAAATGATTCTCAATTACGAGATGATAGTTTATCAGAGTTTGG
AATTTGATCTTATTGTCTATGCACCATATCGATCTGTTGAAGGTTTTGTTGCTGATATAGAGGAAT
TCTGTCATCCAACAGATGAAAATATTGAAAAGCTGAAGGAAATTGCAGTGGCAGAGGTTGACAAAA
TCATGCTCACTGACGCACCCGTTATGTTCCCTCCTGGGCAGTTGGCATTGGCTGCTCTGCAGAGTG
CAAATGAGATGCATAGAGTTCTTGATTTTGAGAGATATCTCGAGAGTGTCCTCTCTCGTCAGAATT
CTGCACACATGATTTCAGAGATCAGTGAATCTCTACATGCTGTCGAGAAATGGGTGAGGAAATACA
GTTTCCCTACGGATAAGGATATGAAGCACATAAATCGGAAGCTGAAATCATGCTGGGGTCATAACT
CACACGATGACAATAAGAAAAGGGAGAAGAAATCAAAACACAAGTCCCATAAGAGTTCGAATGAAA
TGCAAAATGGCCCAGGACTGACTTAATTGTATGTTGCTCCTTCGTTCACAAGTGTTTCCTACCTTA
TTTAAGCGATTTACGAACTTGGTTTTTGCTTCCCAGATTTTTGTTGGAGATTATATTTATGTACCA
ATTTGGATGAAAAAAA
```

SEQ ID NO: 175, AAD02871.1, CAK associated cyclinH homolog [Populus tremula x Populus tremuloides]
```
MADFQSSSHKAKWIFTPQQLAEKYKATNNRAKQMLEKYGTTRMRVDVDGSLSYPEPQVNMTENADK
HSRSKPISVEEEQFMRVYYEYKLREVCSAFYFPHKIQATALLYFKRFYLQWSVMEHDPKHVMLTCI
YAACKIEENHVSAEELGKGISQDHQMILNYEMIVYQSLEFDLIVYAPYRSVEGFVADIEEFCHPTD
ENIEKLKEIAVAEVDKIMLTDAPVMFPPGQLALAALQSANEMHRVLDFERYLESVLSRQNSAHMIS
EISESLHAVEKWVRKYSFPTDKDMKHINRKLKSCWGHNSHDDNKKREKKSKHKSHKSSNEMQNGPG
LT
```

FIGURE 17 (continued)

SEQ ID NO: 176, AB038234.1, Oryza sativa cycH-1 mRNA for cyclin H-1, complete cds
CGACGACGCCTCCCTCGTACGCCGGCGCTCTCGCAGTTGCCGCCGCCGCCGCGAACGCCCACCGCC
CGCGCTCTGGTCGGTGGATCGTGACGTGCTGTGGTGGTCTCTGATCTGCTCTGGGGGTGGGTGGGC
GTCTCGCGGAGTCGCCGTGTTCGTCGAGGGCTCGATCGGCTCGGGGAGAGCGAGTGAGAAGAGGTG
AGGGTTGGGGGGAGGCACATCCGCGGCGGCGGAGAGATGGCGGATTTCCGGACCTCCACGCATCGG
GAGAGGTGGATCTTCCAGACGAACGATCTGATGGATAGATGGGGGCGGCGAACCAGCGGGCCACG
GAGACGCTCGTTCAGTATGGAACGACGCGGTTGAAGGTGGACCCTGTTGATGGGTCGCTGTCATAC
CCGGAACCTGCGCCTGATCATGTTGTAGGGAGCTCAGGTGTAAAGCCTCTGTCTTGTGAAGAGGAG
CGATTGATGCGGGTATTTTATGAGCAAAAGATTCAAGAAGTATGTTCAGCATTTAAGTTCCCTCAC
AAAATCCAGGCTACCGCAATAATATATTTCAAGAGATTTTATCTGCAATGGTCTGTAATGGAACAT
CACCCAAAGCATATTATGTTAACTTGTATTTATTCTTCTTGCAAAGTGGAAGAAAATCATGTTTCT
GCTGAGGAACTTGGTAAAGGAATTCAACAGGACCACCAGATTATTCTAAATAACGAGATGATTGTT
CTCAAATCTTTAGATTTTGATCTGATTGTTTATGCTCCGTATCGATCTATCGAAGGATTTGTTGAT
GACATGGAGGATTTCTGCAGAGCAGGTAATGGTGAGCACCAACGGTTGCAGGATTTACGTCAAACT
GCGATATCTCAGGTTGACAAAATGATGTTGACTGACGCTCCTCTTCTCTACACTCCTGGACAGTTG
GCTCTGGCTGCTTTGCACAAATCCAATGATATGCACAAGATCCTTAATTTTGAAAGGTACTTGGAA
AGTGTTTTTTCAAGGCAACATTCTGATTGTCCAATCGAACAATTTGTTGGGTCAATCAATATGATC
AATTATTTGGTTGAGCAGCTTAAAATACCTACTCCTAAGGACATGAGGCATATTGACCGCAAGCTT
AAGCATTGTTTGGATCCAAGCTCACAGGATGAGCATAAGAAGAAAGAGAAGAAGTCGAAGCACAAA
TCAAAAAGGGCAGCTAATGAAGCCCAACTTGACAGCTAGAAAACATACGGTTGGGCTGCACCGTGT
AAGAATCAGTTCTTTAGTTTGTTGTGGCTCCAATTGATCAAAAGAGCTACTTTCCTGAGCAGGTGA
GGTTCCGTTTTAGCCGAGGACAACCAATTTTGAGATGAAGCGAGATAATACCCATGACCTCGCCTT
CTTGTAATCTTGTATGCCTGGAAGCCCTAGCAAACTCCTCGTTGCAATGGCTACTGTACTTTTTTT
GGGGGGTAATTTATCCCTTGTCAAATGGGAAGAAGCAGCATACATCGGATGATTGCCTCCATATAC
GAAAATGACAGCTAACTCAGACTTTTGTCGGTTGCATTTTCTGTTTAAAAAAAAAAAAAAAAAAA
AAAAAAAAA

SEQ ID NO: 177, BAB11694.1, cyclin H-1 [Oryza sativa]
MADFRTSTHRERWIFQTNDLMDRWGAANQRATETLVQYGTTRLKVDPVDGSLSYPEPAPDHVVGSS
GVKPLSCEEERLMRVFYEQKIQEVCSAFKFPHKIQATAIIYFKRFYLQWSVMEHHPKHIMLTCIYS
SCKVEENHVSAEELGKGIQQDHQIILNNEMIVLKSLDFDLIVYAPYRSIEGFVDDMEDFCRAGNGE
HQRLQDLRQTAISQVDKMMLTDAPLLYTPGQLALAALHKSNDMHKILNFERYLESVFSRQHSDCPI
EQFVGSINMINYLVEQLKIPTPKDMRHIDRKLKHCLDPSSQDEHKKKEKKSKHKSKRAANEAQLDS

SEQ ID NO: 178, BT014266.1, Lycopersicon esculentum clone 133491F, CycH mRNA sequence
GGAAAATGCCAGTTTATTGGAAAGAGAATTAGAATCGGCAGATAAAAGATATGGCGGATTTCATGA
CATCTACTCATAAAACCAAGTGGATTTATACTCTCCAAGATATTAAACATAAGTACAAAGTTGCTA
ATCAAAGGGCGAAACAAGCACTAGAGATGTTTGGAACAACTCGAATGGAAGTTGATATTGATGGGA
CTTTCTCGTATGCTGAAAGTCAAAATGACACAAAAGATAACGCTGAAAAGCGTCCTAAACCACTCA
AAGTTGAAGAAGAACAGCTTCTAAGGGCTTTCTACGAATTCAAAATTCAAGACGTTTGTGATGCCT
TTAAGTTCCCTCGTAAGATTCAGGCAACAGCCCTCATTTATTTTAAGAGGTTTTATCTGCTGTGGT
CCGTGATGGAACATCACCCCAAAGACATTATGTTAACGTGCATATATGCAGCTTGCAAGGCAGAGG
AAAATCATGTATCAGCTGAGGAGCTTGGTAAGGGGATTGGACAGGATCATCATGTTATCCTCAATA
ATGAGATGCTGGTTTTTCAGAGTCTAGGATTTGATCTTATTGCTTATGCTCCATATCGTGCACTCG
AAGGTTTTATCAGTAATTTAGAGGAGTTCTGTGGAGCTCAAGATAACGACCAGCTTCTGGCACTGA
AGGGTGCACTTGATACTGCTAGGATTGAAGCAGATAAGATTATGCGTAGTGATGGACCACTTCTAT FIGURE 17 (continued)

```
TCCCACCTGGGCAGTTGGCATTGACAGCTCTGCATAGAGCTGATGCAGCGCATGGCATATTCGATT
TTGAGAGGTACTTGAGAAGTGTCCTATCACATCATGATCAGCCAGGTCATGCCATTTCAGAACTTA
CTGATTCTATAAACGTTATCGATTCTTTGGTTGGTAAACTTTTGACTCCGACTTCCAAAGACGTGA
AGCACATTGATCGGAAACTCAAATCATGTCTTGATCCGGGTTCACATGACAAGAGTAAAAAAAGGA
AGCATAGATCCAAAGATAGCTCAAATGAGGTTACAGACATCTCTTGAGCTGCTCTTAACTCAAGTT
TGTAGCTTCAAGCGTATGTTATTTGGCAATAGTTCATCATTGCTGCTCATCACAGTTTCCAGATAT
AGAGCAAAAAATCCAGTCATACTGGAAGACACCGTCTACTACATTTGCATTAGGTTTGAGAGAAGA
AGCAGACGCGGAAATGGGATCAAAGTTTATGAATTGAACTCATTGTATTGTTTAAATTACGGGATT
TGATCTTATATTTGTTCAGATTTTTAGTAGTTATATCGAAAGTTATGATTCAGATGAACATGTAGT
CAAAGCCCCAACATCTTGTCCCAGAGAAGATCACATTGTTAAAGATGTGTAAGTAAGAATGGACTT
ATTTGTCTGTTTTAATATAACTTTTTTGGTTTTAAAAAAAAAAAAAAA
```

SEQ ID NO: 179, Lycopersicon esculentum CycH, deduced protein sequence (51-1037)
```
MADFMTSTHKTKWIYTLQDIKHKYKVANQRAKQALEMFGTTRMEVDIDGTFSYAESQNDTKDNAEK
RPKPLKVEEEQLLRAFYEFKIQDVCDAFKFPRKIQATALIYFKRFYLLWSVMEHHPKDIMLTCIYA
ACKAEENHVSAEELGKGIGQDHHVILNNEMLVFQSLGFDLIAYAPYRALEGFISNLEEFCGAQDND
QLLALKGALDTARIEADKIMRSDGPLLFPPGQLALTALHRADAAHGIFDFERYLRSVLSHHDQPGH
AISELTDSINVIDSLVGKLLTPTSKDVKHIDRKLKSCLDPGSHDKSKKRKHRSKDSSNEVTDIS
```

SEQ ID NO: 180, Zea mays ZM02LC21628
```
AAAACCATCACCGCCTTCCCGGCGCTCGCCGCTGCCACCCGTCGCCGCGCGCCTTTCCGCCACCCG
CCGCCGCTGTTGGCGCCCAAACATCGCATCTGCTGTTGCTTTATCCCTTTTATTCCACAGCCGCTC
TAAGTGGTGGGTGTCCCTCTATATTCGCCGCTTATAGGAATCGAGGGTTCGATCGGCTGTGGTGCG
TGGTGACTGTGAACGAGGAGGAGCGCAAAGATGGCTGATTTCCGGACCTCCACCCAACGGGAGAGG
TGGATCTTCCAGTCGCACGATTTGATGGAGAGGTGGGCGGCGGCAAACCAGCGGGCCGCTCAGACC
CTTGCGCAGTATGGGACGACCCGGCTTAATGTGGACCTGCTTGATGGCTCGGTATCCTACCCAGAG
TCCATGCCGGATCATGTTGAGGGTAGCTCGGTTGTAAAGCCTCTTTCTTACGAAGAGGAGCAATTG
ACAAGGGTATTTTACGAGCAGAAGATTCAGGAAGTATGCGCTGCATTCAAGTTCCCTCACAAAATC
CAGGCTACAGCAATAATATATTTCAAGAGATTCTATCTACAATGGTCTGTAATGGAGCATCAACCA
AAGCATATTATGTTAACATGTGTATATGCTTCTTGCAAAGTGGAAGAAAACCATGTTTCTGCTGAG
GAACTTGGTAAAGGAATTCAGCAGGACCACCAGATCATTCTAAATAATGAGATGATTCTTCTTAAA
ACTTTAGATTTTGATCTCATTGTTTATGCTCCATATCGATCGATTGAAGGATTTATTGATGACCTA
GAGGATTTCTGCAGGGCAGGTAATGGTCCATTCCAGCGTTTGAAGGAGTTGCGCCAGGCTGCTATA
TCCCATGTTGACAAAATGATGTTGACTGATGCACCTCTTCTCTATACCCCTGGGCAGTTGGCACTG
GCGGCTCTTCACAAGTCTAATGATCTTCTCAGGGTCGTCGATTTTGAAAGATACTTGGAAATTATC
TTCTCAAGGCAACATTCTGATTGTCCAATCGAACAGTTTGTTCAGTCGATCAACGAAATCAATTAC
TTAGTCGACCAGCTTAATATACCTACTGTCAAAGACATGAGACACGTGGACCGCAAGCTGAAACAT
GCTGGGATCCAAGCTCACATGACGAGCATAACAAGAAGAAAGAAAGAAGTCAAAGCACAAATCG
AAAAGAACATCTACCGATGCCCAACTATAGGAAGCATATGGTCCAGCAGTGGCTTTGTGTAAGAGT
ACAACGGGCCTCCAAATGATCGAAACTGAACTCAGGCATCTAAGCACAGCAGCTCTAAGACAGCTT
TCTACACCAGCTGAGGCATACCTGAGGTCAAGCAATTTTGTGACGATGTGGGCTATGGAACTTCAT
TGCTCCAATGGGAGAGTTGCAGCAAAGATACAAACTAAGAGATGTAACATTGGATGCCTAACTCCA
AAGTACGGAGAACTTCAAATTTTATATGGCCGACTTTGTGTCAGCCACAATTACTTGAGTTCCTTT
TGTTACGGATGTAGCATTGTTTATTAAGTTTAAACGCCGAATCCAAGATGATCCACCTGCTGTTGT
GAATCGTTTTTTAACT
```

FIGURE 17 (continued)

SEQ ID NO: 181, Zea mays ZM02LC21628
MADFRTSTQRERWIFQSHDLMERWAAANQRAAQTLAQYGTTRLNVDLLDGSVSYPESMPDHVEGSS
VVKPLSYEEEQLTRVFYEQKIQEVCAAFKFPHKIQATAIIYFKRFYLQWSVMEHQPKHIMLTCVYA
SCKVEENHVSAEELGKGIQQDHQIILNNEMILLKTLDFDLIVYAPYRSIEGFIDDLEDFCRAGNGP
FQRLKELRQAAISHVDKMMLTDAPLLYTPGQLALAALHKSNDLLRVVDFERYLEIIFSRQHSDCPI
EQFVQSINEINYLVDQLNIPTVKDMRHVDRKLKHCWDPSSHDEHNKKKEKKSKHKSKRTSTDAQL

SEQ ID NO: 182, Triticum aestivum - DNA
CGCTGCCGCTGCCGCCCGTCGCCGCGCCCCTCCTCGGCGTCCTCCGGAAGACGCCATAGTATTGCG
GCATCCCCTCCACACCCGCTTCCATCAAGCGGTGTTCACCAGCAGGGGGGAGGGGGGCTCGATTCG
GCTGCTGGGAGCGGAGGTAGGAGCGGCCAAGATGTCGGATTTCCAGACCTCCACGCACCGGGAGCG
GTGGATCTTCCAGCCGCAGGACCTGGTGAATAAGTGGACGACGGCGAACCGGCGTTCAGCGGAGAT
CCTCGCCCAGTATGGGACGACGAGATTGAAGGTGGACCCTGTTGATGGCTCGATATCGAACCCAGA
ACCTCTGCCTGATCATGTTGTTGGGAGCTCGAGCGTGAAGCCTCTATCCTGCGAAGAGGAGCAAGT
GATGCGGATATTTTACGAGCAAAAGATTCAAGAAGTGTGCAGAGCATTCAAATTCCCCCACAAAAT
TCAGGCTACAGCGATAATATATTTCAAGAGATTCTATCTACAGTGGTCTGTAATGGAGCACCACCC
AAAGCATATTATGTTAACTTGTGTATATGCTTCTTGCAAAGTGGAAGAAAATCATGTTTCTGCTGA
GGAACTTGGCAAAGGGATTCAGCAGGACCACCAGATCATTCTAAATAATGAGATGATTGTTCTGAA
ATCTTTAGATTTTGATTTGATCGGTTTATGCTCCATATCGTTCTATCGAAGGATTTATTGATGACC
TGGATGATTTATGTAGGGCACGTAATGGTGCACACCAACGGTTGAAGGATTTGCATCAAACTGCGA
ATTCTGAGGTTGACACAATGATGTTGACTGATGCACCTCTTCTCTATACTCCTGGACAGTTGGCTT
TGGCTGCTCTGTACAAGTCCAACAGTGCACTCAGTGTCCTCGATTTTGAAAGATACTTGGAAAGTG
TTTTTTCAAGGCAACACTTTGATTGTCCTGTCGAACAATTTATTCAGATAATCAGTTCAATCAATC
ACCTGGTTAGCCAGCTTCAACTACCTGGTACGAAAGAAATGAGGCATGCTGATCGCAAGCTGAAGC
ATTGTTTGGATCCAAGCTCAAGCTCTCATGATGACCACAAGAAGAAAGAAAAGAAGTCAAAGCACA
AATCGAAAAGGACTGCCAGTGATGCCCAGCTCAACAGCTAGAAATCGTGCAGTTGGACAGCTGTGC
TGTGTAAGAAATCGTGCAGTTGGTGGCAAGGACTTGTACTGTGCTAGGCGCGTTAGCTGCTTTATC
ATGCAACCAAGTTCTACTCAAGCTCTTCGATTGATGCGATTTCAATTCCGACTTTATCCAGCCATC
GGATCAGTGATGCTGAGCGGATCTCCTCACCAGCCTAAGTCTTGGCTAAGGACAGACAGTTTTCGG
ATGAGGCGCCTTACTGTAACCTTGCACGTCCTGCGCCAGCGAGTGCTGTGCTTTTTGTAACTCAAT
AATTTTATTATTAGGGAGGCTTAAATCTTGGGCGCGAGGGGAGAGAAACTTTGAGGTGTAAAACAT
TATTACTAGAGTAACTTAGGGCCTGTTTGGTTTCAAATAAGTCACCAACTTTTAGGTCGC

SEQ ID NO: 183, Triticum aestivum - protein
MSDFQTSTHRERWIFQPQDLVNKWTTANRRSAEILAQYGTTRLKVDPVDGSISNPEPVPDHVVGSS
SVKPLSCEEEQVMRIFYEQKIQEVCRAFKFPHKIQATAIIYFKRFYLQWSVMEHHPKHIMLTCVYA
SCKVEENHVSAEELGKGIQQDHQIILNNEMIVLKSLDFDLIVYAPYRSIEGFIDDMDDFCRAGNGA
HQRLKDLHQTANSEVDTMMLTDAPLLYTPGQLALAALYKSNSALSVLDFERYLESVFSRQHFDCPV
EQFIQIISSINHLVSQLQLPGTKEMRHADRKLKHCLDPSSSSHDDHKKKEKKSKHKSKRTASDAQL
NS

SEQ ID NO: 184, Aquilegia formosa TC16339
ATCCCTGTCATGGCGATTCTCATCAGCTCTGGAAATAAAACTATCTAAAACCCTAACAATCTCCTT
CTCTCTCTCTCTCTCTCTCTCTCTCTCTCTCTCTCTCTCTCTCTCTCTCTCTCTCTCTCTCTCTCT
GAAATCTCCATGGCTGATTTCCAAACATCAACGCACCGAGCTAAATGGATTTTCACACCAAATGAA
CTGGTTGAGAAATACAAAGTTTCTAATCAAAGAGCAATCAAAATGCTGAAGGAGTATGGGTCAACA
CGTATAGAAGTGAGTGCTGATGGTTCATTGTCTTACCCTGAACCTCAATTGGATGCAACTAAAGTT
GAAAAGCGCTCCCATACAAAGCCACTTAGTATTGAAGATGAACAACTTATGCGGGTGTTCTATGAA FIGURE 17 (continued)

CAAAAGATTCAAGAAGTGTGTCTAGCCTTTGGATTTCCACAGAAAATTCAGGGTACAGCCATCATT
TATTTCAAGAGGTTCTATTTGCAATGGTCTGTAATGGAGCATCATCCAAAAAATATAATGTTAACG
TGCATATATGCTTCATGTAAAATAGAAGAAAACCATGTATCAGCAGAGGAGCTTGGTAAAGGCATT
CAACAGGATCATCAAGTGATTCTCAACAACGAGATGCTAGTTCTTCAGAGTCTGGGATTTGATCTT
ATTGTGTATGCACCATATCGCTCAATTGAAGGTTTTGTCGATGATATAGAGGATTTCTGCCAAGCA
AACGACCAGCTCGAAATGTTGAAGGACCTGAAAGAAACTGCAAAGTTGGAAGTAGATCGAATTTTA
CTTACAGATGCACCACTTCTGTTCCCACCTGGGCAGTTGGCGTTGGCTGCTTTGCGTAGGTCGAAC
GAGGTACATGGAGTTCTTGATTTTGAGAGATACTTGGGTAGCATCATCTCTCGTCAACAGTCTATG
CACACTAGTTCAGAGCTGATTGAATCTCTGAATCTGATATATTCTCTGCTTGTAAAACTCAAAATG
CCTTCAAGCGATGATATGAAGCCCATAGATAGGAAACTAAGATATTGTTTGGATCCAAGCTTGCAG
GATGATAAGAAACGTGAAAAGAGATCAAAACACAAGTCGAAGAAAAGTTCAAGCGAAAAGCATGGC
TTGCCTTCTTCTACGCCATCTTAATTTCCAAGCCATGTTGTTATTGTGCTTCAGGTGGAGGAGCCT
ATATGTTTTATATACAAAGCAGCTGTTCTTCATGAACAAGAAATGCACCTCGACCCAGTCAGAAT
GTTCACATGTTTTAGAAAGACAGATTGGCAAACTTTCTTCGAGGACCTCTGTTATACACACGGTGT
TCCTCTCCATCCAGTTGCTAATCCATTCACTGTATGGGATATATGGCAGCAAATAGAGCTGGACAT
TATTGTTGTAAAACCAAACCCTCAGTTTATAACCAATGTCAGACTGGTGGCATCAGAAGAGGAGCA
TTTTTTTGAGTTGGTGATATTATTCTTGTTGTGAGCAAATTTTTTTTTTTTTTGGATATATTTC
TGAGCATTTCAGAGTATGTACAACGGGTAGTTGAAATTTTGTTTGT

SEQ ID NO: 185, Aquilegia formosa TC16339
MADFQTSTHRAKWIFTPNELVEKYKVSNQRAIKMLKEYGSTRIEVSADGSLSYPEPQLDATKVEKR
SHTKPLSIEDEQLMRVFYEQKIQEVCLAFGFPQKIQGTAIIYFKRFYLQWSVMEHHPKNIMLTCIY
ASCKIEENHVSAEELGKGIQQDHQVILNNEMLVLQSLGFDLIVYAPYRSIEGFVDDIEDFCQANDQ
LEMLKDLKETAKLEVDRILLTDAPLLFPPGQLALAALRRSNEVHGVLDFERYLGSIISRQQSMHTS
SELIESLNLIYSLLVKLKMPSSDDMKPIDRKLRYCLDPSLQDDKKREKRSKHKSKKSSSEKHGLPS
STPS

SEQ ID NO: 186, Solanum tuberosum TC145118, partial
TTCCTCCATCACAAAGCCTTAAGCCCTTCCGGTATATTAACCCGCTGCTGGTCTCTCCGGGCGATC
GATTCACCGGCGAAAAATCTGCGATCTTCTAGAGATGAAACGCTGGGCCATGGCATAGTTTATTGG
AAGATCACATCCAAACGAAAATTAGAATTGGCAGAGAGAAGACATGGCTGATTTCGTGACATCTAC
TCATAAAACCAAGTGGATTTTTACTCCCCAAGATATTAAACATAAGTATAAAGTTGCTAATCACAG
AGCGAAACAAGCACTAGAGAAGTATGGAACAACGCGAATGGAAGTTGATATTGATGGGTCGTTCTC
GTATGCTGAAAGTCAAAATGACGCAAAAGATAGTGCTGAAAAGCGTCCTAAACCACTCAAGGTTGA
AGAAGAACAACTTCTAAGGGCTTTCTACGAGTTCAAAATTCAAGACGTCTGTGATGCCTTTAAGTT
CCCACGTAAGATTCAGGCGACAGCTCTCATTTATTTTAAGAGGTTTTATCTACAATGGTCCGTGAT
GGAACATCACCCTAAAGACATTATGTTAACCTGCATATATGCAGCTTGCAAGGCAGAGGAAAACCA
TGTATCAGCTGAGGAGCTTGGGAAGGGTATTGGACAGGATCATCATGTAATCCTCAACAATGAGAT
GCTGGTTTTCCAGAGTCTAGGATTTGATCTAATTGTTTATGCTCCATATCGGGCTCTTGAAAGTTT
TATCAGTGATTTAGAGGAATTCTGTGGAGCTAAAGATGAAGACCAGCTTGTGGCACTGAAGGGTTC
ACTTGATACTGCTAGGATTGAAGCAGATAAGATTATGCGTTCTGATGGACCACTTCTATTCCCACC
TGGGCAGTTGGCATTGACAGCTTTGCATAGAGCTAACGCAGCGCATAGCATATTTGATTTTGAGAG
GTACCTAAGAAGTGTCCTATCACATTATGAGCCAGCTCATGCCATTTCAGAACTTGCTGGTTCTAT
AAATGCCATTGATTCTTTGGTTGGCAAACTTTTGACTCCGACTTCCAAAGATGTGAAGCACGTTGA
TCGGAAACTCAAATCATGTCTTGATCCGGGGTTCACATGACAAGAGTAAAAAAGGAAGCATAGAT
CCAAAGATAGCTCACATGAGGCCTACAGACATATCTTGAAACTGCTCTAACTCAGTTTGTAACTTC
AAGCATATCTTATTTTGCCCATGGAATATATTCTCAT

FIGURE 17 (continued)

SEQ ID NO: 187, Solanum tuberosum TC145118, partial
MADFVTSTHKTKWIFTPQDIKHKYKVANHRAKQALEKYGTTRMEVDIDGSFSYAESQNDAKDSAEK
RPKPLKVEEEQLLRAFYEFKIQDVCDAFKFPRKIQATALIYFKRFYLQWSVMEHHPKDIMLTCIYA
ACKAEENHVSAEELGKGIGQDHHVILNNEMLVFQSLGFDLIVYAPYRALESFISDLEEFCGAKDED
QLVALKGSLDTARIEADKIMRSDGPLLFPPGQLALTALHRANAAHSIFDFERYLRSVLSHYEPAHA
ISELAGSINAIDSLVGKLLTPTSKDVKHVDRKLKSCLDPGF

SEQ ID NO: 188, Saccharum officinarum TC69244 partial
CTCCCCGGCGCTCGCCGCTGCCATCCGTCGCCGCGCGCCTTTCCACCGGTCGCCGCCGCTATTCGC
GCCCAAACAGCGCATCCTGCTGTTGTGTCATTCCTTTCCACAGACACCCGCTCTAAGTGGTGGGTG
CCCCGCTATACTCGCCGCTTATCGGAACCGAGGGTTCGATCGGCTGTGGGTGACTGTGAAGGAGGA
GGAGCGCAAGATGGCTGATTTCCGGACCTCAACCCAACGGGAGAGGTGGATCTTCCAGTCGCACG
ATCTGATGGAGAGGTGGGCGGCGGCAAACCAGCGGGCTGCTCAGACCCTTGCGCAGTATGGGACGA
CGCGGCTTAGTGTGGACCTGCTTGATGGCTCGGTCTCCTACCCAGAGCCCGCACCGGATCATGTTG
AGGGTAGCTCGGGTGTAAAGCCTCTGTCTTACGAAGAGGAGCAATTGACACGGGTATTTTATGAGC
AGAAGATTCAGGAAGTATGCGCTGCATTCAAGTTCCCTCACAAATCCAGGCTACAGCAATAATAT
ATTTCAAGAGATTCTATTTACAGTGGTCTGTAATGGAGCATCACCCAAAGCATAATATGTTAACAT
GTGTATATGCTTCTTGCAAAGTGGAAGAAAACCATGTTTCTGCTGAGGAACTTGGTAAAGGAATTC
AGCAGGACCACCAGATCATTCTAAATAATGAGATGATTCTTCTTAAAACTTTAGATTTTGATCTCA
TTGTTTATGCTCCATATCGATCGATTGAAGGATTTATTGATGACCTAGAGGATTTCTGCAGGGCAG
GTAATGGTCCGTTCCAGCGTTTGAAGGAGTTGCGCCAGGCTGCTATATCCCGTGTTGACAAAATGA
TGTTGACTGATGCACCTCTTCTCTATACCCCTGGGCAGTTGGCACTGGCTGCTCTTCACAAGTCCA
ATGATCTTCTCAGGGTCGTCAATTTTGAAAGATACTTGGAAACTATCTTCTCAAGGCAACATTCTG
ATTGTCCGGTCGAACAGTTTGTTCAGTCGATCAACACAATCAATTACTTGGTTGACCAGCTTAATA
TACCTACTGTTAAGGACATGAGGCACGTCGAACGGAAGCTGAAACATTGTTGGGATTCAAGCTCCC
ATTATGAGCCTTAGAAGAAAGAGAAGAAAGTCAAGCCCAAATTTAAAAAGAACATTTGGTGGTTC

SEQ ID NO: 189, Saccharum officinarum TC69244 partial
MADFRTSTQRERWIFQSHDLMERWAAANQRAAQTLAQYGTTRLSVDLLDGSVSYPEPAPDHVEGSS
GVKPLSYEEEQLTRVFYEQKIQEVCAAFKFPHKIQATAIIYFKRFYLQWSVMEHHPKHNMLTCVYA
SCKVEENHVSAEELGKGIQQDHQIILNNEMILLKTLDFDLIVYAPYRSIEGFIDDLEDFCRAGNGP
FQRLKELRQAAISRVDKMMLTDAPLLYTPGQLALAALHKSNDLLRVVNFERYLETIFSRQHSDCPV
EQFVQSINTINYLVDQLNIPTVKDMRHVERKLKHCWDSSSHYEP

SEQ ID NO: 190, AY675100.1, Ostreococcus tauri cyclin H (CycH) gene, complete cds
ATGTGCGATTACGCCTCATCGACGCAGCGCGAGCACTGGCTCCATGAATCCGTCGCCCAGGTCGAC
GCGAGACGCGCGCGCGCGCGTGGAGACGTTCGAGCGCGCGAAAGCATCGAGCGAGTCGTCAACC
TCAGCCATGGAAACCGAAGCGCTGACGCCCGAAGAGGAGCGAACGATCGTGAGGTACCACGAGGCG
AAGATACAATCCGTCTGCGGCGCGTTTGCGCTGCCGAGAAAGGTGAAGAACACGGCGGTGATGCTG
TTCAAGCGCTTCGCGGTGGATTGCGGGACGCACGCGCAATCGCTGAAGATCATGATGCTGACGAGC
GTGTACGTAGCGTGTAAGGTGGAGGAGAGCTACATCTCGGCGGAGGAGTTCTGTAAGGGCGTGAGA
GAGGACCCGTCGCGAGTGTTAGCGGCGGAGGTGACGTTTCTATCTGGATTGAAGTTTCGGTTGGTG
TGCTACGGAGCGACGCGGCCGCTGGACGGGTTCCTGATGGACGTCGAGGACGGTGGGTGCAAGGGA
GCGACGTCGAAACAGCTCATCGAGTGCAGAAAGAAAGCGTTAGATATCGTCGATCGGTTGATGCTG
ACGGACGCGCCGCTGATTCGACCGCCGGGGCAGATCGCGCTGTGCGCGCTTCGTCGGGCCGCGCGC
GAATGCGGGGCGAGTGAACTCGAAAAGTATTGCGAAGACGTCGGCGCGCGAGGGACGACCAAGGCG FIGURE 17 (continued)

CCGCGCGGAGCGAAACTCAAGGAAATCTTAGACGATATCGAATCGCACGTCGACGAGGGCGTTGAA
CCCGACGCGGCTGTCGTGAAGGAGATTGACAAAAAGCTCAAACTCTGGCGTGCCAAATATCTGGCT
AAGACGCCGGCAGCGGACGACGCTGGCGATGCGCAGAAAGCTGCGAAACGTCGAAAGAGCGAACAA
TCTAGACAAGACATGATCGCCGCCGAGGAGGACGCGCTCGGATAA

SEQ ID NO: 191, AAV68602.1, cyclin H [Ostreococcus tauri]
MCDYASSTQREHWLHESVAQVDARRARARVETFERAKASSESSTSAMETEALTPEEERTIVRYHEA
KIQSVCGAFALPRKVKNTAVMLFKRFAVDCGTHAQSLKIMMLTSVYVACKVEESYISAEEFCKGVR
EDPSRVLAAEVTFLSGLKFRLVCYGATRPLDGFLMDVEDGGCKGATSKQLIECRKKALDIVDRLML
TDAPLIRPPGQIALCALRRAARECGASELEKYCEDVGARGTTKAPRGAKLKEILDDIESHVDEGVE
PDAAVVKEIDKKLKLWRAKYLAKTPAADDAGDAQKAAKRRKSEQSRQDMIAAEEDALG

SEQ ID NO: 192, AF074334, Drosophila melanogaster cyclin H homolog (CycH) mRNA, complete cds
CACGAGCTCGTGCCGATTCGGCACGAGCGGCACGAGCTCTCTCTCTCTCTCTCTCTCTCTCTCT
CTCTCTCTCGCAAGATGTATCCTGTGAGCTCGCAAAAGAGGTCCTGGACATTCGCCAATGAGGGCC
AGCTCATGGAGTTCCGCGTGGAGCAGAACAGCAAGTACATCGAGTCGCACGAGGAGGAGGCGCAGG
GTCGCGACCTCAATGAGCACTTTCTCACGTCGGCGGAGGAGCGCCTGTTGCTGAAGCAGTACGAGA
TCTACCTGTTCGATTTCTGCCGCCGCTTCGAACCGACGATGCCCAAGTGCGTTGTGGGCACGGCCT
TCCACTACTTCAAGCGGTTCTATCTGAACAACTCCCCCATGGACTATCACCCCAAGGAGATTCTAG
CCACATGCGTGTTCGTTGCCTGCAAAGTTGAGGAGTTCAACGTGTCCATCAACCAGTTCGTGAACA
ACATCAAGGGCGACAGGAACAAGGCCACCGACATAGTGTTGTCCAATGAATTACTGCTGATTGGAC
AGCTCAACTACTACCTCACCATACACAATCCGTTCAGACCCATCGAGGGTTTCCTGATAGATATAA
AAACTCGCAGCAATATGCAGAATCCAGATCGTCTGCGGCCACATATTGATAGTTTCATTGATTCCA
CGTACTACTCGGATGCCTGTCTTCTGCATACGCCTTCGCAAATTGCATTGGCTGCCGTCCTCCACG
CGGCCAGCAGAGAGCAAGAGAATCTCGATAGCTATGTGACGGATCTTCTGTTTGTCTCCGCCAGGG
AGAAGCTACCCGGACTCATAGATGCCGTGCGAAAAATTCGCATAATGGTGAAGCAATATCAGCAGC
CCGATCGGGAGAAGGTCAAGGCCATCGAGAAAAAGTTGGACAAGTGCCGAAATCAAGCCAATAATC
CTGATAGCGAACTCTATAAGGAGCGCCTACGCCGATTGTACACCGATGAGGATGACATGCCCGCCG
AAGATGCCTCATTCCACATTGCAGATGTGAGCTCGGACACATCTGCTATGAACATCAGCCAATAGA
CTTAAGAATATTTATTTAAATGATGGGATGATCTACTACTGCGTGGATTTCATCGATATTAAAGCA
TTTTGTAATTTACCATTTCTTGATTGTTAAAATGTATGCGTTTAGTGTTAGTTTACTAAACAAAGT
TGGATTAGGTACTTCACTTTTCCAATATATAAAATATTAAAAAAAAAAAAAAAAAAA

SEQ ID NO: 193, AAC26868.1, cyclin H homolog [Drosophila melanogaster]
MYPVSSQKRSWTFANEGQLMEFRVEQNSKYIESHEEEAQGRDLNEHFLTSAEERLLLKQYEIYLFD
FCRRFEPTMPKCVVGTAFHYFKRFYLNNSPMDYHPKEILATCVFVACKVEEFNVSINQFVNNIKGD
RNKATDIVLSNELLLIGQLNYYLTIHNPFRPIEGFLIDIKTRSNMQNPDRLRPHIDSFIDSTYYSD
ACLLHTPSQIALAAVLHAASREQENLDSYVTDLLFVSAREKLPGLIDAVRKIRIMVKQYQQPDREK
VKAIEKKLDKCRNQANNPDSELYKERLRRLYTDEDDMPAEDASFHIADVSSDTSAMNISQ

SEQ ID NO: 194, U12685.1, HSU12685 Homo sapiens cyclin H mRNA, complete cds
CACGATTCCATAATGTACCACAACAGTAGTCAGAAGCGGCACTGGACCTTCTCCAGCGAGGAGCAG
CTGGCAAGACTGCGGGCTGACGCCAACCGCAAATTCAGATGCAAAGCCGTGGCCAACGGGAAGGTT
CTTCCGAATGATCCAGTCTTTCTTGAGCCTCATGAAGAAATGACACTCTGCAAATACTATGAGAAA
AGGTTATTGGAATTCTGTTCGGTGTTTAAGCCAGCAATGCCAAGATCTGTTGTGGGTACGGCTTGT

FIGURE 17 (continued)

```
ATGTATTTCAAACGTTTTTATCTTAATAACTCAGTAATGGAATATCACCCCAGGATAATAATGCTC
ACTTGTGCATTTTTGGCCTGCAAAGTAGATGAATTCAATGTATCTAGTCCTCAGTTTGTTGGAAAC
CTCCGGGAGAGTCCTCTTGGACAGGAGAAGGCACTTGAACAGATACTGGAATATGAACTACTTCTT
ATACAGCAACTTAATTTCCACCTTATTGTCCACAATCCTTACAGACCATTTGAGGGCTTCCTCATC
GACTTAAAGACCCGCTATCCCATATTGGAGAATCCAGAGATTTTGAGGAAAACAGCTGATGACTTT
CTTAATAGAATTGCATTGACGGATGCTTACCTTTTATACACACCTTCCCAAATTGCCCTGACTGCC
ATTTTATCTAGTGCCTCCAGGGCTGGAATTACTATGGAAAGTTATTTATCAGAGAGTCTGATGCTG
AAAGAGAACAGAACTTGCCTGTCACAGTTACTAGATATAATGAAAAGCATGAGAAACTTAGTAAAG
AAGTATGAACCACCCAGATCTGAAGAAGTTGCTGTTCTGAAACAGAAGTTGGAGCGATGTCATTCT
GCTGAGCTTGCACTTAACGTAATCACGAAGAAGAGGAAAGGCTATGAAGATGATGATTACGTCTCA
AAGAAATCCAAACATGAGGAGGAAGAATGGACTGATGACGACCTGGTAGAATCTCTCTAACCATTT
GAAGTTGATTTCTCAATGCTAACTAATCAAGAGAAGTAGGAAGCATATCAAACGTTTAACTTTATT
TAAAAAGTATAATGTGAAAACATAAAATATATTAAAACTTTTCTATTGTTTTCTTTCCCTTTCACA
GTAACTTTATGTAAAATAAATAAACCAT
```

SEQ ID NO: 195, AAA57006.1, cyclin H, Homo sapiens
```
MYHNSSQKRHWTFSSEEQLARLRADANRKFRCKAVANGKVLPNDPVFLEPHEEMTLCKYYEKRLLE
FCSVFKPAMPRSVVGTACMYFKRFYLNNSVMEYHPRIIMLTCAFLACKVDEFNVSSPQFVGNLRES
PLGQEKALEQILEYELLLIQQLNFHLIVHNPYRPFEGFLIDLKTRYPILENPEILRKTADDFLNRI
ALTDAYLLYTPSQIALTAILSSASRAGITMESYLSESLMLKENRTCLSQLLDIMKSMRNLVKKYEP
PRSEEVAVLKQKLERCHSAELALNVITKKRKGYEDDDYVSKKSKHEEEEWTDDDLVESL
```

SEQ ID NO: 196, Phaeodactylum tricornutum.JGI.48763
```
ATGGTAGACTACGACGACAGCACTCAGCTCAACAAATGGCTCTTCCAGTCAACTGACGAACTCGAG
CTTTGCCGAGCGCGGGCAAACAATGAAGCGAGGACTTTTCTGACCAACTCGCCAGGGGAAGAACCG
CTGTTGTTGTCGTCCGAGACAGCCGCAACTCCAACCGAGACTCAACCGCTACCGGTAAAGCACTTC
GCGTATGGTTTTCGCCAGGATTTGCAAACAAATCCTGTTGTCTCTGACTCATATCGAGAAGGGCCG
TTGGAGAATGATGACGGGCACGCTTTCTTGACTCCTGTGGAAGAAGCCACGCTGGTGTCCTTCTAC
GCGTCGAAATTACCCAGTCTGATTGGCCCGAACGCTAGCGTTTCTCGCCTACGACGCGAATCCAAA
GTACCAGCTACTGCCGCACTCTTGTACCGCCGCTTTTTTCTGTCCAATTCTGTGTTACTGTACGAC
CCCAAGGTCATCATGGTGGCAGCCGCATTTCTGGGAAGCAAAGTGGAAGACGCAACGGCTGACGTC
CGGTATCTCGAGGAAGGTACCGCCCTCATGAACGCTCCTGTATCACAGGCCGAAATAATTCCAGCG
GAACTGAATCTGCTATCAGGGACTTACTTTGACTTGCTTTGCTTTCATCCCTACAAGACTGTTCTG
GCCTTGACGGAAGATTTGCGGACCTATCTGAAGTCCGACAAGGGACAAGCGCTGGTATCATGGCCG
CCGACCACGGCCGCTGACGACGACGACGTGAACGTCCCAGCTCCCCTTTTGAGCGGACAGGACTTG
AAACCCATGTACGAGGCTGCCCGGGCTTTGGTAGACGACTGTGTTGTATCGGACATCCCTCTACTG
TACACACCAGGTCAAGTGGGTCTAGCAGCCCTCATGGTTGCGCAGGCCGAGCTACTTGTTCGCAGT
CGAGGCAACGGCGCCAGTAACCAGAAGTCACGAATACCCCAAATTGACCTGGAAGGCTACGTCCGG
CAACGTTTTGATACAGACGAAACACGCGAAATTTCCATGGACACTTTTTGGCAACGTTGCGAACA
CTTCAAACACAGTTACAAGGCTTGCGAGAAGGCCAACTTGGATGTTACAACAATCCCAGCGTCATT
GATATGCAAGCTCTCAAGGCTATACACAAAAAACTGAAAAAGGTTCGAGCCTGGGGAACGTCGGGC
AGTGGGGGGAAAAGTGAAAAAAGAAAAAGAAGCGCGGCTCGCCTGCAGGCGGCGGTACGGCCAAC
GCGGTCGATAGTGGCGAACCGGAGCGGAAGAAAATGAAAGCGTCCGGAGCCCAGTGA
```

SEQ ID NO: 197, Phaeodactylum tricornutum.JGI.48763
```
MVDYDDSTQLNKWLFQSTDELELCRARANNEARTFLTNSPGEEPLLLSSETAATPTETQPLPVKHF
AYGFRQDLQTNPVVSDSYREGPLENDDGHAFLTPVEEATLVSFYASKLPSLIGPNASVSRLRRESK
VPATAALLYRRFFLSNSVLLYDPKVIMVAAAFLGSKVEDATADVRYLEEGTALMNAPVSQAEIIPA
```

FIGURE 17 (continued)

```
ELNLLSGTYFDLLCFHPYKTVLALTEDLRTYLKSDKGQALVSWPPTTAADDDDVNVPAPLLSGQDL
KPMYEAARALVDDCVVSDIPLLYTPGQVGLAALMVAQAELLVRSRGNGASNQKSRIPQIDLEGYVR
QRFDTDETREISMDTFLATLRTLQTQLQGLREGQLGCYNNPSVIDMQALKAIHKKLKKVRAWGTSG
SGGKSEKKKKKRGSPAGGGTANAVDSGEPERKKMKASGAQ
```

FIGURE 17 (continued)

Remorin domain
                                                                    PF03763 gi|184107441|ref|NP_567050.1|      GSENNIVLASS--GGQNRMVTTASVQ------------RVKREEVEAKI 189
gi|67064251|emb|CAB66111.1|        GSENNIVLASS--GGQNRMVTTASVQ------------RVKREEVEAKI 149
gi|15227454|ref|NP_181718.1|       GS--GLDPGSD--NGPGQSRVGSTVQ------------RVKREEVEAKI 167
gi|124360195|gb|ABN08208.1|        TSRRNMASGSSRASGQGGSEEHVSVD------------RVKKEEVDAKI 175
gi|115472875|ref|NP_001060036.     RAHLALPAPGDVSSAGGHGDEVSVG-------------QVKKEEVESKI 212
gi|10214003|gb|ABF70164.1|         RP---LPA-GDSGAAN--PADEVPVH------------LVKKEEVESKI 168
gi|115456099|ref|NP_001051650.     RSR--ASQLEVVPAAGPSPAPPVEAR------------QVKKEEVETKV 180
gi|113610699|dbj|BAF21077.1|       ------------AAAG--SGPPAPVE------------QVKKEEVEAKV 156
gi|23197616|gb|AAN15335.1|         ------------------EGSVNRDAVLA---------RVETEKRMSLI 97
gi|42573455|ref|NP_974824.1|       ------------------EGSVNRDAVLA---------RVETEKRMSLI 96
gi|14423538|gb|AAK62451.1|AF38     ------------------EGSVNRDAVLA---------RVETEKRMSLI 97
gi|21555669|gb|AAM63910.1|         ------------------EGSVNRDAVLA---------RVETEKRMSLI 97
gi|15229057|ref|NP_190463.1|       ------------------VGSVHRDAVLV---------RLEQDKRISLI 70
gi|6522572|emb|CAB62016.1|         ------------------VGSVHRDAVLV---------RLEQDKRISLI 70
gi|18815851|gb|AAB49425.1|         ------------------EGSIDRDAVLA---------RVATEKRVSLI 93
gi|47315731|gb|AAD28506.1|AF123    ------------------EGSIDRDAVLA---------RVATEKRLSLI 92
gi|92877744|gb|ABE84731.1|         ------------------SDIVLA--------------EVTKEKKLCYV 28
gi|601843|gb|AAA57124.1|           S-----------------SGSADRDVILA---------DLEKEKKTSFI 85
gi|152258991|ref|NP_182106.1|      S-----------------SGSADRDVILA---------DLEKEKKTSFI 85
gi|15233068|ref|NP_191685.1|       A-----------------SASLDRDVKLA---------DLSKEKRLSFV 107
gi|115447549|ref|NP_001047554.     ATA---------------TATPTRTSNDRDIALA-----KVETDKRESLI 96
gi|115459618|ref|NP_001053409.     PAQ---------------GG----SNDRDVALA------RVETEKRNSLI 99
gi|48835301|gb|AAD28507.2|AF123    KSS---------------KG----SFDRDVALA------HLEEEKRNSYI 68
gi|113547193|dbj|BAF10636.1|       ------------------GSAERDAYLA----------KIVSEKRLVLI 68
gi|115449889|ref|NP_001048576.     P-----------------TGSVDRDAILA---------NVELERKLSMI 72
gi|7267406|emb|CAB80876.1|         ------------------MEPNIPIQ------------RGNSYHR--VL 17
gi|79458120|ref|NP_191976.2|       ------------------MEPNIPIQ------------RGDEQSK--VI 17

FIGURE 20

| ID | Sequence | # |
|---|---|---|
| gi\|79320867\|ref\|NP_001031248.1 | ESNNSEKVNGFVES----------------------------------KKAMSAMEARA | 233 |
| gi\|184088804\|ref\|NP_564900.1 | ESNNSEKVNGFVES----------------------------------KKAMSAMEARA | 233 |
| gi\|113536885\|dbj\|BAF09268.1 | RAARKRADQGHDEV---------------------------AGTITAVSP-A | 223 |
| gi\|152207251\|ref\|NP_174322.1 | GKMNIAAWASKEEE-ENKKNNG--------------DAEEAQKIEFEKRA | 399 |
| gi\|115460610\|ref\|NP_001053905. | GKMNIATWASKEEL-ELVSASPSI--------------ADLERMKKEYAARA | 172 |
| gi\|113649772\|dbj\|BAF30284.1 | GKMNIASWASKDDDDELPRASPEKRPRPRPHSGDGGEAKKREFEARA | 317 |
| gi\|113547257\|dbj\|BAF10700.1 | GKTTIAAWASKEEK---STTSFAN----------VITDKAVEIDREARA | 315 |
| gi\|115443805\|ref\|NP_001045682. | GKTNIAAWASNKEEEKDASLSLKG-----------VPMDQSTQKVTEIRA | 402 |
| gi\|277764932\|gb\|AAO23587.1 | GKFNIAAWASKEDEDKDASTSLKT----------KASLQTSKSVSEARA | 377 |
| gi\|42562741\|ref\|NP_175789.2 | ---VTSHWNSREEEE-------EEISKS----LRHFDMESELRRSVSESKAP- | 327 |
| gi\|92884019\|gb\|ABE87162.1 | YDLVAPNWSSSEEEE-------KEISKS----LRHN------ASLKADSDCIAA- | 350 |
| gi\|113645505\|dbj\|BAF28646.1 | -DAMLINWSSKEEEE-------EEVSKS----LRHFEASVAAVG-EKRGGAGD | 363 |
| gi\|239284411\|gb\|AAN40027.1 | AHATLVGWSSSKEEEDDDEDVSKS----LRHFEATVGGTACDRRGGGGD | 321 |
| gi\|83853834\|gb\|ABC47866.1 | DEHVTVTRWSKKHRALFTGRGSEK----------VESWKK-ELSTQS | 417 |
| gi\|92888879\|gb\|ABE89592.1 | DERVTMTRWSKKHKALFTGRGSEN----------VDSWKKKETSTRS | 511 |
| gi\|42571771\|ref\|NP_973976.1 | DEKVTVTRWSKKHRGLYHGNGSKM----------RDHVHG-------- | 446 |
| gi\|113631594\|dbj\|BAF25275.1 | DDRVTLTRWSKKHVTRASSKNSTN----------VIDVKKTVESKS | 512 |
| gi\|115476840\|ref\|NP_001062016. | DDRVTLTRWSKKHVTRGSEKNSTN----------IIEWKKKTVESKS | 493 |
| gi\|115448895\|ref\|NP_001048227. | DDQVTVTRWSKKRHVTRGSDRRSTN----------IVEWRKKTIETRA | 316 |
| gi\|72706461\|emb\|CAB80363.1 | DKGARMIKRPKRRVMSSRIIRREQ----------PEVEDNSEASASS | 303 |
| gi\|12597780\|gb\|AAG60092.1\|AC07 | QSVMNESTVQRAK--------------------------PEHMAAVV | 109 |
| gi\|12325086\|gb\|AAG52495.1\|AC01 | Q------------------------------------------------ | 89 |
| gi\|30697834\|ref\|NP_849866.1 | PSPLRLPPRETKRQSSEHT---------------------SRKDDSTA | 240 |
| gi\|152222980\|ref\|NP_172845.1 | -------------------------------------------ADTKT | 134 |
| gi\|115451495\|ref\|NP_001049348. | SREKKESKKFEQDKANQMPSLASAPT---------SSYSSEAEAMA | 252 |
| gi\|113638961\|dbj\|BAF26266.1 | RKKLLEYPSENRRPQEIGSSSGTS----------GLASASSKA | 156 |
| gi\|152401951\|ref\|NP_200936.1 | AGGAYEGSDHNGGAFNHSDGENSPVAVQRMGRWPQGSAVKHKENFVHAKL | 295 |
| gi\|113537166\|dbj\|BAF09549.1 | YNIVLPSVREESPLPRTITSCINRHG----------GCSSNPKLEADH | 183 |
| gi\|92883543\|gb\|ABE86981.1 | | |

FIGURE 20 (continued)

Remorin domain PF03763 (cont'd)

```
gi|18410744|ref|NP_567050.1|      TAWQ-TAKVAKINNRFKRQDAVINGWLNEQVHRANSWMKKIE------RKL 233
gi|6706425|emb|CAB66111.1|        TAWQ-TAKVAKINNRFKRQDAVINGWLNEQVHRANSWMKKIE------RKL 193
gi|15227454|ref|NP_181718.1|      TAWQ-TAKLAKINNRFKREDAVINGWFNEQVNKANSWMKKIE------RKL 211
gi|12436019S|gb|ABN08208.1|       SAWQ-NAKVAKINNRFKRDDAVINGWESEQVQKATSWMKKVE------RKL 219
gi|11547287S|ref|NP_001060036.    AAWQ-IAEVAKVNNRFKREEVVINGWEGDQVEKANAWLKKYE------RKL 256
gi|10214003З|gb|ABF70164.1|       SAWQ-TAEVSKINNRFKRQEVTINGWENEKVEKATAWLKKVE------RKL 212
gi|11545609|ref|NP_001051650.     SAWQ-TAEVAKINNRFKREEVVINGWETEQVEKASAWLKKIE------RKL 224
gi|113610699|dbj|BAF21077.1|      AAWQ-AEEVAKINNKFKREEVVINGWESQQVDKATAWLAKIE------RKL 200
gi|23197616|gb|AAN15335.1|        KAWE-EAEKCKVENKAEKKLSSIGSWENNKKAAVEAELKKME------EQL 141
gi|42573455|ref|NP_974824.1|      KAWE-EAEKCKVENKAEKKLSSIGSWENNKKAAVEAELKKME------EQL 140
gi|14423538|gb|AAK62451.1|AF38    KAWE-EAEKCKVENKAEKKLSSIGSWENNKKAAVEAELKKME------EQL 141
gi|21555669|gb|AAM63910.1|        KAWE-EAEKCKVENKAEKKLSSIGSWENNKKAAVEAELKKME------EHL 141
gi|15229057|ref|NP_190463.1|      KAWE-EAEKSKVENKAQKKISSVGAWENSKKASVEAELKKIE------EQL 114
gi|65225572|emb|CAB62016.1|       KAWE-EAEKSKVENKAQKKISSVGAWENSKKASVEAELKKIE------EQL 114
gi|18881585|gb|AAB49425.1|        KAWE-ESEKSKAENKAQKKVSAIGAWENSKKANLEAELKKME------EQL 137
gi|47315733|gb|AAD28506.1|AF123   KAWE-ESEKSKAENKAQKKVSAIGAWENSKKANLESELKKME------EQL 136
gi|928777444|gb|ABE84731.1|       KAWE-ESEKSKAENKAQKKISIAAWEDSKKAALEAELKKIE------EQL 72
gi|60184Э|gb|AAA57124.1|          KAWE-ESEKSKAENKAQKKISDVHAWENSKKAAVEAQLRKIE------EKL 129
gi|15225899|ref|NP_182106.1|      KAWE-ESEKSKAENRAQKKISDVHAWENSKKAAVEAQLRKIE------EKL 129
gi|15233068|ref|NP_191685.1|      RAWE-ESEKSKAENKAEKIADVHAWENSKKAAVEAQLKKIE------EQL 151
gi|11544754|ref|NP_001047554.     KAWE-ENEKAKAENRASKKLLDIISWENTKKAVIKTQLKKKE------EEL 140
gi|11545961|ref|NP_001053409.     KAWE-ENEKTKAENKASKKLSAILSWENTKKANIEAQLKKIE------EQL 143
gi|48883530|gb|AAD28507.2|AF123   KAWE-ESEKSKVNNKAEKKLSSVGTWENTKKANIEAKLKKLE------EQL 112
gi|113547193|dbj|BAF10636.1|      NAWE-ESEKARAENRAAKKLSYITSWENAKKAEMEAELKRIE------QEL 112
gi|11544988|ref|NP_001048576.     KAWE-ESEKSKAENKAQKKMSSILSWENTRKAAIEAKLRTQE------EKL 116
gi|7267406|emb|CAB80876.1|        VLFS-FM------LTQKKLLDISGWEKKKTTKIESELARIQ------RKM 54
gi|79458120|ref|NP_191976.2|      KAWK-ELKITKVNNKTQKKLLDISGWEKKKTTKIESELARIQ------RKM 61
gi|79320867|ref|NP_001031248.1    MAWD-EAERAKFMARYKREEVKIQAWENHEKRKAEMEMKKME------VRC 277
gi|18408804|ref|NP_564900.1|      MAWD-EAERAKFMARYKREEVKIQAWENHEKRKAEMEMKKME------VKA 277
```

| Accession | Sequence | Length |
|---|---|---|
| gi\|113536885\|dbj\|BAF09268.1\| | ERMRLRAQARTAGKLATAQAEAKARRARAEAELALGRPGGAKGW------ | 312 |
| gi\|152220725\|ref\|NP_174322.1\| | EQMKAEAEAKIMKKIALAKQRSEEKRALAEARKTRDAEKAVAE------ | 486 |
| gi\|115460610\|ref\|NP_001053905. | EKLRSEAMAKMAEKLEMTRRLAEEKRASANARMNQQAAKAVHK------ | 259 |
| gi\|113649772\|dbj\|BAF30284.1\| | EQMKARAKQKLSRRLSALSHKAEGKQARVEARRSRQAARLARQ------ | 404 |
| gi\|113547257\|dbj\|BAF10700.1\| | EIKRAREQDRLSSKLAAARHKAEAREAAESRKNQEAARTEEQ------ | 402 |
| gi\|115443805\|ref\|NP_001045682. | ERMRARAQDKLMSQLASARHTADEKRAAAELKRSRAAAKTAEQ------ | 489 |
| gi\|27764932\|gb\|AAO23587.1\| | ERIKGRAQDRLMKKLATIERKAEEKRAAAEAKKDHQAAKTEKQ------ | 464 |
| gi\|42562741\|ref\|NP_175789.2\| | QKMRSNLEEKLMKRMDMVHRRAEDWRATARQQHVEQMQKAAETAR------ | 416 |
| gi\|92884019\|gb\|ABE87162.1\| | QKMRSNLEEKLMKRMSVVHRKAEDWRETARQQHLEQMEKSTQHAK------ | 438 |
| gi\|113645505\|dbj\|BAF28646.1\| | QKMRSNLEEKLMRRMTTVHRRAEEWRATAQAQHLQQLKRAAEQVR------ | 452 |
| gi\|23928441\|gb\|AAN40027.1\| | QKMRCNLEEKLMRRMTTVQRRAGEWRATARAQHLQQLRRAAAHGDGDGRR | 415 |
| gi\|83853834\|gb\|ABC47866.1\| | EKRRASSMDKIMNKLRLAQKKAQEMRSSVPHNQTDRVVRTSH------ | 503 |
| gi\|92888879\|gb\|ABE89592.1\| | EKKRASSMDKIMNKLKFAQKKAQEMRSSVSVDQAHQVARTSH------ | 597 |
| gi\|42571771\|ref\|NP_973976.1\| | EKKRSSSMEKIMRKVKSAEKRAEEMRRSVLDN---RVSTASHG------ | 530 |
| gi\|113631594\|dbj\|BAF25275.1\| | EKKRSSSLDKIWNTLRSAQRRAQVMRETAAANQDEQSSGKAK------ | 597 |
| gi\|115476840\|ref\|NP_001062016. | EKKRSYSLERIFNTLRSAHRKTHVIRSTTTNLDQHISRTVK------ | 579 |
| gi\|115448895\|ref\|NP_001048227. | EKKRSSSMDRILGKLRTAQKKAQDMRSAVSVSEDQCGVRATK------ | 402 |
| gi\|7270646\|emb\|CAB80363.1\| | EKKKSASMDKILNKLQTAKIKAQEMRRSSVSSEHEQQGNHQI------ | 390 |
| gi\|12597780\|gb\|AAG60092.1\|AC07 | EKTKLKATQRFRDENERIEIIVASARAHAYESRIKEELKVKEK------ | 196 |
| gi\|12325086\|gb\|AAG52495.1\|AC01 | EKTKLKATQRFRDENERIEIIVASARAHAYESRIKEELKVKEK------ | 163 |
| gi\|30697834\|ref\|NP_849866.1\| | EKTKLKATQRFRDENERIEIIVASARAHAYESRIKEELKVKEK------ | 105 |
| gi\|152222980\|ref\|NP_172845.1\| | EQRRKRGLQRFREDTEYIEQIAAGARAQAEKDRQSKEFKVKEK------ | 328 |
| gi\|115451495\|ref\|NP_001049348. | DQKRAKALEEYSQEITRINKIAGGARTMAEERKYNDEKKIKEK------ | 221 |
| gi\|113638961\|dbj\|BAF26266.1\| | ERRKEKALEEYNDEITRINKVAAASRLTAEEKRRSAERKVREK------ | 340 |
| gi\|152240195\|ref\|NP_200936.1\| | EKRKGINNQHYKSKLARIQLIADGAKKQLEEKRRSKEAQVHGK------ | 243 |
| gi\|113537166\|dbj\|BAF09549.1\| | EKKRARAAEKMQKAIKDAQKKADKKKIKEHAATDNQIASVERA------ | 382 |
| gi\|92883543\|gb\|ABE86981.1\| | ERKQVMASARAQKKIYSVREKAEKQKLNLRRSTMKKFQQLIH------ | 271 |

FIGURE 20 (continued)

Remorin domain PF03763 (cont'd)                                    at least 1 C and/or F

```
gi|184107441|ref|NP_567050.1|      ------ANLMRAVGRPPAKR-------------SFFSLS---  296
gi|67064251|emb|CAB66111.1|        ------ANLMRAVGRPPAKR-------------SFFSLS---  256
gi|152274541|ref|NP_181718.1|      ------ANLMRALGRPPAKR-------------SFFSFS---  274
gi|124360195|gb|ABN08208.1|        ------ANLMRAVGRPPAK--------------KSFF-----  279
gi|115472875|ref|NP_001060036.     ------ANFMRAVGRAPSK--------------RSFF-----  316
gi|102140033|gb|ABF70164.1|        ------ANFMRAVGRAPSK--------------RSFF-----  272
gi|115456099|ref|NP_001051650.     ------ANFMRAVGRVPTK--------------RSFF-----  284
gi|113610699|dbj|BAF21077.1|       ------ANFCKAAGRVPSK--------------RSFFSF---  262
gi|231976161|gb|AAN15335.1|        ------AAKYRATGTAPKKL-------------FGCM-----  202
gi|42573455|ref|NP_974824.1|       ------AAKYRATGTAPKKL-------------FGCM-----  201
gi|144235381|gb|AAK62451.1|AF38    ------AAKYRATGTAPKKL-------------FGCM-----  202
gi|215556691|gb|AAM63910.1|        ------AAKYRATGTAPKKL-------------FGCM-----  202
gi|152290571|ref|NP_190463.1|      ------AAKYRATGTAPTKL-------------FGFF-----  175
gi|65225721|emb|CAB62016.1|        ------AAKYRATGTAPTKL-------------FGFF-----  175
gi|118815851|gb|AAB49425.1|        ------AAKYRATGTAPKKI-------------LGIF-----  198
gi|47315731|gb|AAD28506.1|AF123    ------AAKYRATGTAPKKI-------------LGIF-----  197
gi|92877744|gb|ABE84731.1|         ------AAKYRATGTTPKKT-------------IGCF-----  133
gi|60184311|gb|AAA57124.1|         ------GAKYRATGVVPKAT-------------CGCF-----  190
gi|152258991|ref|NP_182106.1|      ------GAKYRATGVVPKAT-------------CGCF-----  190
gi|152330681|ref|NP_191685.1|      ------AAKYRATGIVPKAT-------------CGCF-----  212
gi|115447549|ref|NP_001047554.     ------AAKYRATGVTPKKH-------------IGCFGA---  203
gi|115459618|ref|NP_001053409.     ------AAKYRATGHAPKKL-------------IGCFGA---  206
gi|48883530|gb|AAD28507.2|AF123    ------AAKYRATGQAPKKI-------------GCLGC----  174
gi|113547193|dbj|BAF10636.1|       ------AAKYRAKGEAPTKL-------------FGLLKA---  175
gi|115449889|ref|NP_001048576.     ------AAKHRSKGTTPTKFLS-----------CFGS-----  179
gi|72674061|emb|CAB80876.1|        ------AARFQAAGKIPKKSS------------LSCF-----  116
gi|79458120|ref|NP_191976.2|       ------AARFQAAGKIPKKSS------------LSCF-----  123
gi|79320867|ref|NP_001031248.1     ---------DSGREEG-----------------ECGG-----  308
gi|18408804|ref|NP_564900.1|       ------ADYIRRSGHLP-SSFSFSFKLPSR---CWCQ-----  347
```

```
                                                    at least 1 C and/or F
gi|113536885|dbj|BAF09268.1|    ---LLTRSASWSSGSGR-SPSSLSLRLP-------------LLCR----- 340
gi|152220725|ref|NP_174322.1|   ----------------AQYIRETGRIP-ASSYKI-----CCGWFS----- 509
gi|115460610|ref|NP_001053905.  ----------------AELIRQTGRVP-GSCIL----CCSGCFCQH----- 284
gi|113649772|dbj|BAF30284.1|    ----------------VHRIRETGAAP-SRLRR-----CCSWLFL----- 427
gi|113547257|dbj|BAF10700.1|    ----------------AAQIRKTGHIP-SSIS------CWCWCL----- 423
gi|115443805|ref|NP_001045682.  ----------------ADHIRRTGRMP-SSIG------CWNWCS----- 510
gi|277764932|gb|AAO23587.1|     ----------------AEQIRRTGKVP-SLLF------SCFSFCS----- 486
gi|425627411|ref|NP_175789.2|   ----------------KLTNRRGYLVT-GRSS----CGCLP-CNNTCH----- 442
gi|92884019|gb|ABE87162.1|      ----------------KIIHRHNSQFS-RHSS----CGCFP--CNNNH----- 463
gi|113645505|dbj|BAF28646.1|    -RAKATS-HHHHHHHLA-GSNAS----CGCFP--CNGSNN----- 483
gi|239288441|gb|AAN40027.1|     LRATATSTAHHHHHRHLP-GSSDAPSCACFPCSTSTSGGGGVFYLKRVATE 464
gi|83853834|gb|ABC47866.1|      ----------------KASSFLRTS-----QMRSLSG-------CFTCHVF----- 526
gi|92888879|gb|ABE89592.1|      ----------------KVMSFRRAG-----QMGSLSG-------CFTCHAF----- 620
gi|425717711|ref|NP_973976.1|   ----------------KASSFKRSGKK---KIPSLSG-------CFTCHVF----- 555
gi|113631594|dbj|BAF25275.1|    ----------------RTSHLNKNGQ-----ISSLSG-------CFTCHAF----- 620
gi|115476840|ref|NP_001062016.  ----------------RPSHLSKNGQ-----MSSLSG-------CFTCHAF----- 602
gi|115448895|ref|NP_001048227.  ----------------KASYLRRTG------KSFSC--------CFTYRAC----- 423
gi|72706464|emb|CAB80363.1|     ----------------SRNSVKITHLVRRHTFMTPFMTCFAPRVD--CRKSSSAL-- 427
gi|125977780|gb|AAG60092.1|AC07 ----------------ANLMRTTGRKP-----------------STCL------- 211
gi|123325086|gb|AAG52495.1|AC01 ----------------ANLMRTTGRKP-----------------STCL------- 178
gi|30697834|ref|NP_849866.1|    ----------------ANLMRTTGRKP-----------------STCL------- 120
gi|152222980|ref|NP_172845.1|   ----------------AGVIRSTGKLPGN-----------------ACCF------- 345
gi|115451495|ref|NP_001049348.  ----------------ANKRRLSEKAPRA------------------CACF------- 238
gi|113638961|dbj|BAF26266.1|    ----------------AERIRVTGKLPGA--------------------CGCF------- 357
gi|152240195|ref|NP_200936.1|   ----------------VKKMSRTGKVPNNY-----------------FCFRCY----- 263
gi|113537166|dbj|BAF09549.1|    ----------------MVKMSRTGKLPWS--------------------LAFL------- 399
gi|92883543|gb|ABE86981.1|      -----------------ETHSSSDTSWDSH------------------LPLC------- 288
```

SEQ ID NO: 198 - Arabidopsis thaliana - DNA
GTTACACGAATTATTAAAACCTAATCATTGATTATTTATTCCTGACCTTGTTTCTTCTCCTTCCAT
CACCTAATTATAATCAGACCTAAACTAGCTAATTACAACACTCCACTACTACTACTACTACAACTC
TTCTGATGTTGACTTTGTACGGTCAAGAAAGGTCACCGGAGAACTCCACCACAAGTACGACCGATG
CTTCCGATCGCCGGGATGAGACGCCGTCGTCGGAGATAGTCGTGAGAGATATTCACGCGATGACGA
CGACGACAGAGCTTACTCGGCCACAACAAAGGGGATCAGGAGGAGGATACTTGTCTCCGTCGAGGT
CTATTGCTTTTAGCGACGGAACTACTTCTTCCGGTGAGAATTTCACCACCGTGAGCAGAGAGTTCA
ACGCTCTAGTCATCGCCGGATCTTCCATGGACAACAACAGTAACGGAACTAACCAATCAGGTGGTC
ATCGTGACGTCATACGTGATGAAAGAAACGAGCTGACTAGGATCGGCGAAAACGATGACGTTGGTG
ATCATGGTCAGGTGCCTGAGGAGGATTCAAATCCATGGGCGATTGTACCGGACGATTACAACAACC
GGGACGGTTCAGAGAATAATATTGTGTTGGCGTCATCAGGTGGTCAGAACCGGATGGTGACGACTG
CTTCGGTGCAGAGGGTGAAGAGAGAAGAGGTGGAAGCAAAGATAACGGCGTGGCAAACGGCGAAGG
TGGCTAAGATTAATAATAGGTTTAAGAGACAAGACGCCGTTATTAACGGTTGGTTGAATGAGCAGG
TTCATAGAGCTAACTCTTGGATGAAGAAAATCGAGAGGAAACTGGAAGATAGGAGAGCGAAGGCGA
TGGAGAAAACACAAAACAAAGTGGCAAAAGCTCAGAGGAAGGCGGAGGAGAGGAGAGCCACGGCGG
AAGGTAAACGAGGGACGGAGGTTGCGAGGGTTCTTGAAGTTGCTAATCTCATGAGAGCCGTTGGAC
GACCTCCGGCCAAACGATCATTCTTCTCTCTTTCCTAGCTAAGCTATTACTAGTTTTAGTTACATC
CAAATGTCTCAATATATATAGGCTACCATTTTCTGTTGGGAATCAATGTGTATATAACTATATATA
GAATGTAAGAGTTTTAAAGGTACTGATATATTTTGTAATTGTATGCTTTTTTCTTTGTCTGCACCA
CATAAAAACTAATAAAATGTTATTTGTAAGCCAAGAAAATTGTTTACATGTATTGTTTTGTCATTC

SEQ ID NO: 199 - Arabidopsis thaliana - protein
MLTLYGQERSPENSTTSTTDASDRRDETPSSEIVVRDIHAMTTTTELTRPQQRGSGGGYLSPSRSI
AFSDGTTSSGENFTTVSREFNALVIAGSSMDNNSNGTNQSGGHRDVIRDERNELTRIGENDDVGDH
GQVPEEDSNPWAIVPDDYNNRDGSENNIVLASSGGQNRMVTTASVQRVKREEVEAKITAWQTAKVA
KINNRFKRQDAVINGWLNEQVHRANSWMKKIERKLEDRRAKAMEKTQNKVAKAQRKAEERRATAEG
KRGTEVARVLEVANLMRAVGRPPAKRSFFSLS

SEQ ID NO: 200 - Arabidopsis thaliana - DNA
AAAATAAAAACAGTTAATCTCTCTAAAACAATTTTTTGTTTTCTCTCTCTCTTAAATAACCAGAGA
GTTCAGAATCATTTTGATTCTCTTTGTAATCTTTAGTTGTTGTACCTAACATCATGGCTGAAGAGG
AACCGAAGAAGGTGACAGAGACCGTGTCGGAACCAACTCCAACACCGGAAGTTCCGGTGGAGAAAC
CTGCTGCTGCTGCAGATGTTGCTCCTCAGGAGAAGCCTGTGGCTCCACCTCCCGTTCTTCCATCTC
CGGCACCGGCAGAGGAGAAGCAAGAAGACTCTAAGGCTATTGTTCCCGTCGTCCCTAAAGAAGTAG
AGGAAGAGAAGAAAGAAGGATCAGTTAATCGAGATGCTGTTCTGGCTAGAGTTGAGACAGAGAAGA
GGATGTCACTTATCAAAGCTTGGGAAGAGGCTGAGAAATGCAAAGTGGAGAACAAAGCTGAGAAGA
AGCTTTCTTCAATTGGATCATGGGAGAACAACAAGAAAGCAGCTGTGGAAGCTGAGCTCAAGAAAA
TGGAGGAGCATTTGGAGAAGAAAAAGCAGAGTATGTGGAGCAGATGAAGAACAAAATAGCTCAAA
TTCACAAGGAAGCAGAAGAGAAGAGAGCAATGATTGAAGCTAAGCGTGGAGAAGAAATTCTCAAAG
CAGAGGAATTAGCAGCCAAGTACCGTGCCACTGGAACCGCTCCCAAAAAGCTTTTCGGATGCATGT
GATCTCTAATCATCTCGATGGGGAAACAAATGAAATATGGTATTGATGTAATGACGTTCTTTAGTT
TGCTTAATGTGGGTTTAATATGGCAACATAGAAAGTTATAAGGTCAACATCTTATATTGATTGGGG
TGCGTTTGTTAATTATTTAATTTGTATTTGTACATCTTTCCATTGAAAGGCTTTCTCTTAGCTTT

SEQ ID NO: 201 - Arabidopsis thaliana - protein
MAEEEPKKVTETVSEPTPTPEVPVEKPAAAADVAPQEKPVAPPPVLPSPAPAEEKQEDSKAIVPVV
PKEVEEEKKEGSVNRDAVLARVETEKRMSLIKAWEEAEKCKVENKAEKKLSSIGSWENNKKAAVEA
ELKKMEEHLEKKKAEYVEQMKNKIAQIHKEAEEKRAMIEAKRGEEILKAEELAAKYRATGTAPKKL
FGCM

FIGURE 22

SEQ ID NO: 202 - Arabidopsis thaliana - DNA
GGAAATAATATCTTCAATTTTTCATATTTCGTTTTTAATTTGGTTTTCTTTTTTCCTCTCTATTTC
TTCGGCTGAGAGGCGGCGACTATGGCGGAGGAACAGAAGATAGCGTTAGAATCAGAATCTCCGGCG
AAGGTTACGACTCCTGCTCCAGCAGATACACCGGCTCCAGCTCCGGCAGAGATTCCGGCTCCAGCT
CCAGCTCCGACTCCGGCTGATGTCACGAAAGACGTTGCAGAGGAGAAAATTCAAAACCCACCTCCG
GAGCAAATTTTCGATGACTCCAAAGCCCTTACTGTTGTTGAGAAACCTGTAGAAGAGCCTGCACCG
GCGAAACCTGCGTCTGCATCGCTCGATAGAGATGTTAAGCTAGCTGATTTGTCAAAGGAAAAGAGA
TTGTCTTTCGTCAGAGCGTGGGAAGAAAGCGAAAAGAGCAAAGCAGAGAACAAAGCTGAGAAGAAG
ATTGCAGATGTTCATGCTTGGGAAAACAGCAAGAAAGCAGCTGTCGAAGCGCAACTCAAGAAAATC
GAGGAGCAACTAGAGAAGAAGAAAGCAGAGTATGCAGAGAGGATGAAGAATAAGGTTGCAGCGATT
CACAAGGAAGCAGAAGAGAGAAGAGCAATGATTGAAGCTAAGCGTGGAGAAGACGTTCTTAAAGCA
GAAGAAACGGCTGCTAAATACAGAGCCACTGGAATTGTTCCAAAGGCAACTTGTGGATGTTTCTAA
TCTTGAATTTGCGAATCAAAGTTTCAAGACTTCGTAACTGTAAAGTGTAATCAAATTTCTCTGTTC
TCTTTAATGGCTTGTAATGTTGTTTGTATATTGATTTTGTGTGTGACAATCAGAGTGAAAAATATG
TTTCATTGTTTTCTTTCCGC

SEQ ID NO: 203 - Arabidopsis thaliana - protein
MAEEQKIALESESPAKVTTPAPADTPAPAPAEIPAPAPAPTPADVTKDVAEEKIQNPPPEQIFDDS
KALTVVEKPVEEPAPAKPASASLDRDVKLADLSKEKRLSFVRAWEESEKSKAENKAEKKIADVHAW
ENSKKAAVEAQLKKIEEQLEKKKAEYAERMKNKVAAIHKEAEERRAMIEAKRGEDVLKAEETAAKY
RATGIVPKATCGCF

SEQ ID NO: 204 - Arabidopsis thaliana - DNA
CGAGTGATTGATATTTTATTATAGATTTAATACACACCCGACACTCTGTCAATTCTATAGGCATAC
GAGCTCACTCCAAATTTAGATTCAGTTTTTTAATACGAACTTTTTAGTTAAGCCAAGATTAGCAAT
AATATAGATCATTTATTTTCTTGATTGTAGTTTGATTGTTGTTTTTCTCATAATAAAAAAATCCCA
GCTAAAATCTGATTTTCAATTTTAAACCAATTTATATGGTAAACAAAATTTTAGTTCGGTATAATT
GGAAGAATTAAGTTTTGTTGAATATCAGGAAAAAGAAGGGGAGGACAAATTTTCTACAGAGGTGA
CGTGGCATCATTGAACCACTTTACTTGTCGGCAGTGAGGTGTGTTTAATCACGTGTAACGCATCCA
ATGCGTATGAGAGCTTTACAGCCGCACGATCACATGGGTACAAAAATCAACGGCGAAGCAAACAA
GAGTCTCACACTTATTAAAGCCACGTAGCACTCCACCGGTATAAGCTAACGGAGGATATAAAAACT
CTTTAACTCATTATTGTCCTAAAATCTCAATTTTATCCATTTTCACGGAAAAAACATAAAATCTGT
TCTTCTTCTTCGGCTGAGAGACAATGGCGGAGGAGCAAAAGACGAGTAAGGTTGACGTAGAATCTC
CGGCTGTTTTAGCTCCGGCGAAGGAACCGACTCCTGCTCCGGTGGAAGTCGCGGATGAGAAAATTC
ATAATCCACCTCCCGTCGAGTCCAAAGCTCTTGCCGTTGTAGAAAGTAAGCTTTCTATTTACATAC
GTGTGTGTTTTATATATGTTAATCTTCTACTTAGGAGGATTCATTCATGTTTACGATGAATTATTA
TAGTATGTAATTCAGAATTCTTACGTTTGGAACTAAGGTTTCAATTTACAATTAACAAATGGATTT
TCTTAAGATGCCTAAGGTTTTTGTGAGTTCTTTTGCATATGACTTGGTCTATACTCTATTTGTTTA
GGTGAAATCCATCGCTGTTAGAATTTACAACTTCATCATGGTATTTTCAAGAGAATTATGTTTTTC
GAGGATGATATTATTAAAATATGATTAATAGTAAAGCAATGTTCCCTGTAATTAGTGTTATCAAAA
AGTGTATGGAATCATGACAAATTAGTTGTGGACAGCTATGAATTAAGGAAAGTGGGTTACTTTCTT
AATATTCCTACATTTTTCCTTCCTTTAAAGTTGCTTAACTCTTGGAAAATAACGATTAAGTACTA
ACTTTCCAGCAGTTTTATAATCCTTGAACATTCATTTGTTCATCTTTATTTACTATATGTAATTC
CTTCTGTGTGGAGTTTCGTTTTATAAACTACTATTTTGATGACCTTATTAGCCAATTAGAGCAACA
AAATTTAACTTAGTTAAAAGTGAGCTTCTTGCAACAAATATCCATGTGTTATACTTATAAGTGTGC
TTCTTGCAGAACCCATCGAGGAGCATACACCTAAGAAAGCTTCATCTGGTTCGGCCGATAGAGGTC
AGCTGATAACAACACTTTGTTTCTCATGTCCAGTTTCTTAGTTACTTAGTTCAGTAATTTACTTCA
AATGTGTGTTGTGTGTGTTTGGTCAGATGTGATACTTGCCGACTTGGAAAAAGAGAAGAAAACGTC FIGURE 22 (continued)

ATTCATCAAAGCATGGGAAGAGAGTGAGAAGTCAAAGGCTGAGAACAGGTAAACTTTCATCATCTT
CTCACCCAAAGATTACTATTGCTTACAGATCTCTGATGATCTTGAAATGAGCAGGGCACAAAAGAA
GATCTCTGATGTGCATGCTTGGGAAAATAGCAAGAAAGCAGCCGTAGAAGCTCAACTTAGGAAGAT
CGAGGAAAAATTAGAGAAGAAAAAGCGCAGTACGGTGAGAAATGAAGAACAAAGTAGCTGCAAT
CCACAAGTTAGCAGAAGAGAAGAGAGCAATGGTTGAAGCTAAAAAGGAGAAGAGCTTCTCGAAGC
TGAAGAAATGGGTGCTAAGTATAGAGCCACTGGTGTAGTACCAAAGGCAACGTGTGGATGTTCTA
AGCCTTTATTGAATTTGTATCTTTGTAACAATTCATCTCTGTTTCTTTCTTCTTTTGTTTTTG
TGTGATTCAACAACTCTTTTTAGTTTTTGTTATTTGTTTGGTCGTTTGTGTCTTGTTTACATATTG
GGTGATTGTGTGTAAAAGTGAAAGATTAATGGAGTATAATTGTATGAAGCATCAAATCTTGTTTTG
CCTTTTGTTTCAGTTGTACGACTTCACATCTGATCTGTAACTCTTAAAATGCTAAGACACTTGACT
TGACACACACCAACTATAATCCTTAAACAGTTCAGGCACAGGTGGA

SEQ ID NO: 205 - Arabidopsis thaliana - protein
MAEEQKTSKVDVESPAVLAPAKEPTPAPVEVADEKIHNPPPVESKALAVVEKPIEEHTPKKASSGS
ADRDVILADLEKEKKTSFIKAWEESEKSKAENRAQKKISDVHAWENSKKAAVEAQLRKIEEKLEKK
KAQYGEKMKNKVAAIHKLAEEKRAMVEAKKGEELLEAEEMGAKYRATGVVPKATCGCF

SEQ ID NO: 206 - Arabidopsis thaliana - DNA
ATGGCTGAAGAGGAACCGAAGAAGGTGACAGAGACCGTGTCGGAACCAACTCCAACACCGGAAGTT
CCGGTGGAGAAACCTGCTGCTGCTGCAGATGTTGCTCCTCAGGAGAAGCCTGTGGCTCCACCTCCC
GTTCTTCCATCTCCGGCACCGGCAGAGGAGAAGCAAGAAGACTCTAAGGCTATTGTTCCCGTCGTC
CCTAAAGAAGTAGAGGAAGAGAAGAAGGATCAGTTAATCGAGATGCTGTTCTGGCTAGAGTT
GAGACAGAGAAGAGGATGTCACTTATCAAAGCTTGGGAAGAGGCTGAGAAATGCAAAGTGGAGAAC
AAAGCTGAGAAGAAGCTTTCTTCAATTGGATCATGGGAGAACAACAAGAAAGCAGCTGTGGAAGCT
GAGCTCAAGAAATGGAGGAGCAATTGGAGAAGAAGAAGGCAGAGTATGTGGAGCAGATGAAGAAC
AAAATAGCTCAAATTCACAAGGAAGCAGAAGAGAAGAGAGCGATGATTGAAGCTAAGCGTGGAGAA
GAAATTCTCAAAGCAGAGGAATTAGCAGCCAAGTACCGTGCCACTGGAACCGCTCCCAAAAAGCTT
TTCGGATGCATGTGATCTCTAATCATCTCGATGGGGAAACAAATGAAA

SEQ ID NO: 207 - Arabidopsis thaliana - protein
MAEEEPKKVTETVSEPTPTPEVPVEKPAAAADVAPQEKPVAPPPVLPSPAPAEEKQEDSKAIVPVV
PKEVEEEKKEGSVNRDAVLARVETEKRMSLIKAWEEAEKCKVENKAEKKLSSIGSWENNKKAAVEA
ELKKMEEQLEKKKAEYVEQMKNKIAQIHKEAEEKRAMIEAKRGEEILKAEELAAKYRATGTAPKKL
FGCM

SEQ ID NO: 208 - Arabidopsis thaliana - DNA
AACGAGAAACAGAACATCACTACCAAACATCTCCAGCTCAGTTTCTTCAAATAAAAACAGTTAATC
TCTCTAAAACAATTTTTTGTTTCTCTCTCTTAAATAACCAGAGAGTTCAGAATCATTTTGATTC
TCTTTGTAATCTTTAGTTGTTGTACCTAACATCATGGCTGAAGAGGAACCGAAGAAGGTGACAGAG
ACCGTGTCGGAACCAACTCCAACACCGGAAGTTCCGGTGGAGAAACCTGCTGCTGCTGCAGATGTT
GCTCCTCAGGAGAAGCCTGTGGCTCCACCTCCCGTTCTTCCATCTCCGGCACCGGCAGAGGAGAAG
CAAGAAGACTCTAAGGCTATTGTTCCCGTCGTCCCTAAAGAAGTAGAGGAAGAGAAGAAGGA
TCAGTTAATCGAGATGCTGTTCTGGCTAGAGTTGAGACAGAGAAGAGGATGTCACTTATCAAAGCT
TGGGAAGAGGCTGAGAAATGCAAAGTGGAGAACAAAGCTGAGAAGAAGCTTTCTTCAATTGGATCA
TGGGAGAACAACAAGAAAGCAGCTGTGGAAGCTGAGCTCAAGAAATGGAGGAGCAATTGGAGAAG
AAGAAGGCAGAGTATGTGGAGCAGATGAAGAACAAAATAGCTCAAATTCACAAGGAAGCAGAAGAG
AAGAGAGCGATGATTGAAGCTAAGCGTGGAGAAGAAATTCTCAAAGCAGAGGAATTAGCAGCCAAG

FIGURE 22 (continued)

```
TACCGTGCCACTGGAACCGCTCCCAAAAAGCTTTTCGGATGCATGTGATCTCTAATCATCTCGATG
GGGAAACAAATGAAATATGGTATTTGATGTAATGACGTTCTTTAGTTTGCTTAATGTGGGTTTAAT
ATGGCAACATAGAAAGTTATAAGGTCAACATCTTATATTGATTGGGCTGCGTTTGTTAATTTGATT
TGTATTTGTACATCTTTTCATTGAAAGGCTTTCTCTTAGCTTTAT
```

SEQ ID NO: 209 - Arabidopsis thaliana - protein
```
MAEEEPKKVTETVSEPTPTPEVPVEKPAAAADVAPQEKPVAPPPVLPSPAPAEEKQEDSKAIVPVV
PKEVEEEKKEGSVNRDAVLARVETEKRMSLIKAWEEAEKCKVENKAEKKLSSIGSWENNKKAAVEA
ELKKMEEQLEKKKAEYVEQMKNKIAQIHKEAEEKRAMIEAKRGEEILKAEELAAKYRATGTAPKKL
FGCM
```

SEQ ID NO: 210 - Arabidopsis thaliana - DNA
```
ACAGAACATCACTACCAAACATCTCCAGCTCAGTTTCTTCAAATAAAAACAGTTAATCTCTCTAAA
ACAATTTTTTGTTTTCTCTCTCTTAAATAACCAGAGAGTTCAGAATCATTTTGATTCTCTTTGT
AATCTTTAGTTGTTGTACCTAACATCATGGCTGAAGAGGAACCGAAGAAGGTGACAGAGACCGTGT
CGGAACCAACTCCAACACCGGAAGTTCCGGTGGAGAAACCTGCTGCTGCTGCAGATGTTGCTCCTC
AGGAGAAGCCTGTGGCTCCACCTCCCGTTCTTCCATCTCCGGCACCGGCAGAGGAGAAGCAAGAAG
ACTCTAAGGCTATTGTTCCCGTCGTCCCTAAAGTAGAGGAAGAGAAGAAAGAAGGATCAGTTAATC
GAGATGCTGTTCTGGCTAGAGTTGAGACAGAGAAGAGGATGTCACTTATCAAAGCTTGGGAAGAGG
CTGAGAAATGCAAAGTGGAGAACAAAGCTGAGAAGAAGCTTTCTTCAATTGGATCATGGGAGAACA
ACAAGAAAGCAGCTGTGGAAGCTGAGCTCAAGAAAATGGAGGAGCAATTGGAGAAGAAGAAGGCAG
AGTATGTGGAGCAGATGAAGAACAAAATAGCTCAAATTCACAAGGAAGCAGAAGAGAAGAGAGCGA
TGATTGAAGCTAAGCGTGGAGAAGAAATTCTCAAAGCAGAGGAATTAGCAGCCAAGTACCGTGCCA
CTGGAACCGCTCCCAAAAAGCTTTTCGGATGCATGTGATCTCTAATCATCTCGATGGGGAAACAAA
TGAAATATGGTATTTGATGTAATGACGTTCTTTAGTTTGCTTAATGTGGGTTTAATATGGCAACAT
AGAAAGTTATAAGGTCAACATCTTATATTGATTGGGCTGCGTTTGTTAATTTGATTTGTATTTGTA
CATCTTTTCATTGAAAGGCTTTCTCTTAGCTTTAT
```

SEQ ID NO: 211 - Arabidopsis thaliana - protein
```
MAEEEPKKVTETVSEPTPTPEVPVEKPAAAADVAPQEKPVAPPPVLPSPAPAEEKQEDSKAIVPVV
PKVEEEKKEGSVNRDAVLARVETEKRMSLIKAWEEAEKCKVENKAEKKLSSIGSWENNKKAAVEAE
LKKMEEQLEKKKAEYVEQMKNKIAQIHKEAEEKRAMIEAKRGEEILKAEELAAKYRATGTAPKKLF
GCM
```

SEQ ID NO: 212 - Arabidopsis thaliana - DNA
```
ATGGCTGAAGAGGAACCGAAGAAGGTGACAGAGACCGTGTCGGAACCAACTCCAACACCGGAAGTT
CCGGTGGAGAAACCTGCTGCTGCTGCAGATGTTGCTCCTCAGGAGAAGCCTGTGGCTCCACCTCCC
GTTCTTCCATCTCCGGCACCGGCAGAGGAGAAGCAAGAAGACTCTAAGGCTATTGTTCCCGTCGTC
CCTAAAGAAGTAGAGGAAGAGAAGAAAGAAGGATCAGTTAATCGAGATGCTGTTCTGGCTAGAGTT
GAGACAGAGAAGAGGATGTCACTTATCAAAGCTTGGGAAGAGGCTGAGAAATGCAAAGTGGAGAAC
AAAGCTGAGAAGAAGCTTTCTTCAATTGGATCATGGGAGAACAACAAGAAAGCAGCTGTGGAAGCT
GAGCTCAAGAAAATGGAGGAGCAATTGGAGAAGAAGAAGGCAGAGTATGTGGAGCAGATGAAGAAC
AAAATAGCTCAAATTCACAAGGAAGCAGAAGAGAAGAGAGCGATGATTGAAGCTAAGCGTGGAGAA
GAAATTCTCAAAGCAGAGGAATTAGCAGCCAAGTACCGTGCCACTGGAACCGCTCCCAAAAAGCTT
TTCGGATGCATGTGA
```

FIGURE 22 (continued)

SEQ ID NO: 213 - Arabidopsis thaliana - protein
MAEEEPKKVTETVSEPTPTPEVPVEKPAAAADVAPQEKPVAPPPVLPSPAPAEEKQEDSKAIVPVV
PKEVEEEKKEGSVNRDAVLARVETEKRMSLIKAWEEAEKCKVENKAEKKLSSIGSWENNKKAAVEA
ELKKMEEQLEKKKAEYVEQMKNKIAQIHKEAEEKRAMIEAKRGEEILKAEELAAKYRATGTAPKKL
FGCM

SEQ ID NO: 214 - Arabidopsis thaliana - DNA
ATGACTTTAGAGGAGCAGAAGAAAGTCATAATGCCCGAGGCCGTCGCATCGGAGCCATCACCACCA
TCCAAGGAGGAGAAGTCCGACGATTCGAAAGCTATTGTTCTCGTCGTCGCTGCAAAAGAACCTACG
GAAGACAAGAAAGTAGGTTCAGTTCACCGAGATGCTGTTTTGGTTAGACTCGAGCAAGATAAGAGG
ATATCTCTAATCAAAGCTTGGGAAGAGGCTGAGAAATCCAAAGTGGAGAACAAAGCTCAGAAGAAG
ATTTCTTCAGTTGGAGCTTGGGAAAACAGCAAGAAAGCTTCTGTGGAAGCTGAGCTAAAAAAGATC
GAGGAGCAACTAAATAAGAAGAAAGCACACTACACAGAGCAAATGAAGAACAAGATAGCTCAAATC
CACAAGGAAGCTGAGGAGAAGAGAGCGATGACCGAAGCTAAACGCGGAGAAGATGTTCTCAAAGCC
GAAGAAATGGCTGCAAAGTACCGTGCCACCGGAACTGCTCCAACCAAGCTATTTGGATTCTTCTGA

SEQ ID NO: 215 - Arabidopsis thaliana - protein
MTLEEQKKVIMPEAVASEPSPPSKEEKSDDSKAIVLVVAAKEPTEDKKVGSVHRDAVLVRLEQDKR
ISLIKAWEEAEKSKVENKAQKKISSVGAWENSKKASVEAELKKIEEQLNKKKAHYTEQMKNKIAQI
HKEAEEKRAMTEAKRGEDVLKAEEMAAKYRATGTAPTKLFGFF

SEQ ID NO: 216 - Arabidopsis thaliana - DNA
AACTCATTATTGTCCTAAAATCTCAATTTTATCCATTTTCACGGAAAAAACATAAAATCTGTTCTT
CTTCTTCGGCTGAGAGACAATGGCGGAGGAGCAAAAGACGAGTAAGGTTGACGTAGAATCTCCGGC
TGTTTTAGCTCCGGCGAAGGAACCGACTCCTGCTCCGGTGGAAGTCGCGGATGAGAAAATTCATAA
TCCACCTCCCGTCGAGTCCAAAGCTCTTGCCGTTGTAGAAAAACCCATCGAGGAGCATACACCTAA
GAAAGCTTCATCTGGTTCGGCCGATAGAGATGTGATACTTGCCGACTTGGAAAAAGAGAAGAAAAC
GTCATTCATCAAAGCATGGGAAGAGAGTGAGAAGTCAAAGGCTGAGAACAGGGCACAAAAGAAGAT
CTCTGATGTGCATGCTTGGGAAAATAGCAAGAAAGCAGCCGTAGAAGCTCAACTTAGGAAGATCGA
GGAAAAATTAGAGAAGAAAAAAGCGCAGTACGGTGAGAAAATGAAGAACAAAGTAGCTGCAATCCA
CAAGTTAGCAGAAGAGAAGAGAGCAATGGTTGAAGCTAAAAAAGGAGAAGAGCTTCTCAAAGCTGA
AGAAATGGGTGCTAAGTATAGAGCCACTGGTGTAGTACCAAAGGCAACGTGTGGATGTTTCTAAGC
CTTTATTGAATTTGTATCTTTGTAACAATTCATCTCTGTTTCTTTCTTCTTCTTTTGTTTTTGTGT
GATTCAACAACTCTTTTTAGTTTTTGTTATTTGTTTGGTCGTTTGTGTCTTGTTTACATATTGGGT
GATTGTGTGTAAAAGTGAAAGATTAATGGAGTATAATTGTATGAAGCATCAAATC

SEQ ID NO: 217 - Arabidopsis thaliana - protein
MAEEQKTSKVDVESPAVLAPAKEPTPAPVEVADEKIHNPPPVESKALAVVEKPIEEHTPKKASSGS
ADRDVILADLEKEKKTSFIKAWEESEKSKAENRAQKKISDVHAWENSKKAAVEAQLRKIEEKLEKK
KAQYGEKMKNKVAAIHKLAEEKRAMVEAKKGEELLKAEEMGAKYRATGVVPKATCGCF

SEQ ID NO: 218 - Arabidopsis thaliana - DNA
ATGGAGCCAAATATTCCGATCCAAGAGGTAACTCATATCACAGAGTTTTAGTATTGTTTAGTTTC
ATGTTGACTCAGAAGAAGCTACTAGATATTTCAGGATGGGAGAAAAAGAAAACTACAAAGATCGAA
TCTGAACTCGCTAGAATTCAGCGGAAGATGGACAGTAAGAAGATGGAGAAATCTGAGAAACTAAGG
AACGAAAAAGCGGCAGTTCATGCAAAGGCACAAAAGAAGAAGGCAGATGTTCAAACCAGACGGGCT
CAAGAGATCCTTGATGCGGAAGAAGCTGCTGCTAGGTTTCAAGCCGCAGGAAAGATACCCAAGAAG
TCATCTTTGAGCTGCTTCTGA

FIGURE 22 (continued)

SEQ ID NO: 219 - Arabidopsis thaliana - protein
MEPNIPIQRGNSYHRVLVLFSFMLTQKKLLDISGWEKKKTTKIESELARIQRKMDSKKMEKSEKLR
NEKAAVHAKAQKKKADVQTRRAQEILDAEEAAARFQAAGKIPKKSSLSCF

SEQ ID NO: 220 - Arabidopsis thaliana - DNA
ATGGCTGAAGAGGAACCGAAGAAGGTGACAGAGACCGTGTCGGAACCAACTCCAACACCGGAAGTT
CCGGTGGAGAAACCTGCTGCTGCTGCAGATGTTGCTCCTCAGGAGAAGCCTGTGGCTCCACCTCCC
GTTCTTCCATCTCCGGCACCGGCAGAGGAGAAGCAAGAAGACTCTAAGGCTATTGTTCCCGTCGTC
CCTAAAGAAGTAGAGGAAGAGAAGAAAGAAGGATCAGTTAATCGAGATGCTGTTCTGGCTAGAGTT
GAGACAGAGAAGAGGATGTCACTTATCAAAGCTTGGGAAGAGGCTGAGAAATGCAAGTGGAGAAC
AAAGCTGAGAAGAAGCTTTCTTCAATTGGATCATGGGAGAACAACAAGAAAGCAGCTGTGGAAGCT
GAGCTCAAGAAAATGGAGGAGCAATTGGAGAAGAAGAAGGCAGAGTATGTGGAGCAGATGAAGAAC
AAAATAGCTCAAATTCACAAGGAAGCAGAAGAGAAGAGAGCGATGATTGAAGCTAAGCGTGGAGAA
GAATTCTCAAAGCAGAGGAATTAGCAGCCAAGTACCGTGCCACTGGAACCGCTCCCAAAAAGCTT
TTCGGATGCATGTGA

SEQ ID NO: 221 - Arabidopsis thaliana - protein
MAEEEPKKVTETVSEPTPTPEVPVEKPAAAADVAPQEKPVAPPPVLPSPAPAEEKQEDSKAIVPVV
PKEVEEEKKEGSVNRDAVLARVETEKRMSLIKAWEEAEKCKVENKAEKKLSSIGSWENNKKAAVEA
ELKKMEEQLEKKKAEYVEQMKNKIAQIHKEAEEKRAMIEAKRGEEILKAEELAAKYRATGTAPKKL
FGCM

SEQ ID NO: 222 - Arabidopsis thaliana - DNA
TCATTCTCAATCAAATGGAGCCAAATATTCCGATCCAAAGAGGAGATGAGCAGTCAAAAGTTATTA
AGGCATGGAAGGAACTAAAGATAACAAAGGTCAATAACAAGACTCAGAAGAAGCTACTAGATATTT
CAGGATGGGAGAAAAAGAAAACTACAAAGATCGAATCTGAACTCGCTAGAATTCAGCGGAAGATGG
ACAGTAAGAAGATGGAGAAATCTGAGAAACTAAGGAACGAAAAGCGGCAGTTCATGCAAAGGCAC
AAAAGAAGAAGGCAGATGTTCAAACCAGACGGGCTCAAGAGATCCTTGATGCGGAAGAAGCTGCTG
CTAGGTTTCAAGCCGCAGGAAAGATACCCAAGAAGTCATCTTTGAGCTGCTTCTGAGATCAGCACT
AACCTGTGATACAGATTATCACCTATCTCCGGTATCCTATGTTCATACTTGTATCTTTTGTATGTT
GTGTGTTTTGCTTGTGTTGCTCA

SEQ ID NO: 223 - Arabidopsis thaliana - protein
MEPNIPIQRGDEQSKVIKAWKELKITKVNNKTQKKLLDISGWEKKKTTKIESELARIQRKMDSKKM
EKSEKLRNEKAAVHAKAQKKKADVQTRRAQEILDAEEAAARFQAAGKIPKKSSLSCF

SEQ ID NO: 224 - Arabidopsis thaliana - DNA
ATGAACGAATCCACAGTGCAACGAGCGAAACCTGAACATATGGCAGCTGTTGTGGATCAATGGAAG
GAAACAGAGATAAGCAAATCGAGAAAGAAGTACGAGAAGCTAAGTGAGAAGATTGTGTCATGGGAA
GATAAGAAGAGGAAAAAGGCAAAGAGAAAACTTCATAGAACAGAGAGAAGTGTAGAGAAAACAAAG
TTGAAGGCGACCCAGAGGTTCAGGGACGAAAATGAACGTATTGAGATTATCGTTGCAAGTGCAAGA
GCACATGCGTATGAGAGTCGAATAAAAGAAGAGTTGAAGGTTAAGGAGAAAGCAAACCTCATGAGA
ACAACTGGTAGGAAACCCTCTACATGCCTCTGA

SEQ ID NO: 225 - Arabidopsis thaliana - protein
MNESTVQRAKPEHMAAVVDQWKETEISKSRKKYEKLSEKIVSWEDKKRKKAKRKLHRTERSVEKTK
LKATQRFRDENERIEIIVASARAHAYESRIKEELKVKEKANLMRTTGRKPSTCL

FIGURE 22 (continued)

SEQ ID NO: 226 - Arabidopsis thaliana - DNA
TTAATGTCACATTTCTGAAATCTCTCAACTTCATCATCAAGTGGGTTCCTATGAGAGTGACGACTC
TTTGATTGCTTCGCCACATCTTTTATTTTATCCTTCTAAGTCATTTCTCTATCTATCCATATAGA
TAAAAACCTTCTAATAGATCTCTGTGTCATTTATTCGTAAGAATGAGATCTAGTGTAGAAGATAA
CAAAGGATGGATAGGACCAGCGACACCGGAGATATCGAACGGTTTTGAGTTTCAGAAAGGTTCGAA
CCGGACACCAAACCATCACCGGTCTACTATGGGGAAGCCAGCGCCGTCAAAATGGGACGATGCTCA
GAAATGGCTTTCTGGTGTAGGGTTTGCTCGTGGAGGTGGTGGAGGTGGTGACAAGAGTAGTCATCA
CTCAAGAAGTAATAAGCCGAGAAACTCGAACGCGGATGATCTTAGACTTATAGCTTCAGCTTCACA
GAGAGAACGTGAAGGAGAAGATCAGTACGTTGAGTATGATGATGAAGAGATGGCGGCGGGAAGACC
GGAGGTTGAGACGAAGAATGTTGATTGTGGTGAATCTGTTTGGAGGAAAGAAAGTAGTATTAATCC
AACGGCTGTGATTAGATCCGTTTGTGTGAGAGATATGGGGACTGAGATGACTCCTATTGGTAGTCA
AGAGCCTTCTAGAACAGCTACACCGGTGCGAGCTACTACACCGGTTGGGAGGAGTCCTGTGACTTC
ACCGGTGAGGGCTTCACAACGTGGTGAGGCGGTGGGGGTTGTGATGGAGACGGTGACGGAGGTTAG
GAGGGTAGAGAGTAATAATAGTGAGAAGGTTAATGGTTTTGTGGAGAGTAAGAAGGCTATGAGTGC
TATGGAAGCTCGAGCCATGGCTTGGGATGAAGCAGAACGTGCTAAATTCATGGCTAGGTATAAGAG
AGAGGAAGTGAAGATACAAGCTTGGGAGAATCACGAGAAGAGAAAGGCTGAGATGGAGATGAAGAA
AATGGAGGTAAGATGCGGAGAGGATGAAAGCAAGGGCAGAGGAGAAGTTGGCCAACAAGCTAGCTG
CGACGAAAAGGATAGCGGAAGAGAGGAGGGCGAATGCGGAGGCTAAGTTAAACGAAAAGGCGGTGA
AGACATCGGAGAAAGCTGATTATATAAGGAGGAGTGGTCACTTGCCTTCTTCTTTTTCTTTCTCCT
TTAAGCTTCCCTCTCGTTGTTGGTGTCAATAATTGTCTATTTTCATTAGAATGTAATCGTATGGAT
TTAGTGATATTCAATAACTAACGCAAAAAAAAAAAAAAGTTTT

SEQ ID NO: 227 - Arabidopsis thaliana - protein
MRSSVEDNKGWIGPATPEISNGFEFQKGSNRTPNHHRSTMGKPAPSKWDDAQKWLSGVGFARGGGG
GGDKSSHHSRSNKPRNSNADDLRLIASASQREREGEDQYVEYDDEEMAAGRPEVETKNVDCGESVW
RKESSINPTAVIRSVCVRDMGTEMTPIGSQEPSRTATPVRATTPVGRSPVTSPVRASQRGEAVGVV
METVTEVRRVESNNSEKVNGFVESKKAMSAMEARAMAWDEAERAKFMARYKREEVKIQAWENHEKR
KAEMEMKKMEVRCGEDESKGRGEVGQQASCDEKDSGREEGECGG

SEQ ID NO: 228 - Arabidopsis thaliana - DNA
TTAATGTCACATTTCTGAAATCTCTCAACTTCATCATCAAGTGGGTTCCTATGAGAGTGACGACTC
TTTGATTGCTTCGCCACATCTTTTATTTTATCCTTCTAAGTCATTTCTCTATCTATCCATATAGA
TAAAAACCTTCTAATAGATCTCTGTGTCATTTATTCGTAAGAATGAGATCTAGTGTAGAAGATAA
CAAAGGATGGATAGGACCAGCGACACCGGAGATATCGAACGGTTTTGAGTTTCAGAAAGGTTCGAA
CCGGACACCAAACCATCACCGGTCTACTATGGGGAAGCCAGCGCCGTCAAAATGGGACGATGCTCA
GAAATGGCTTTCTGGTGTAGGGTTTGCTCGTGGAGGTGGTGGAGGTGGTGACAAGAGTAGTCATCA
CTCAAGAAGTAATAAGCCGAGAAACTCGAACGCGGATGATCTTAGACTTATAGCTTCAGCTTCACA
GAGAGAACGTGAAGGAGAAGATCAGTACGTTGAGTATGATGATGAAGAGATGGCGGCGGGAAGACC
GGAGGTTGAGACGAAGAATGTTGATTGTGGTGAATCTGTTTGGAGGAAAGAAAGTAGTATTAATCC
AACGGCTGTGATTAGATCCGTTTGTGTGAGAGATATGGGGACTGAGATGACTCCTATTGGTAGTCA
AGAGCCTTCTAGAACAGCTACACCGGTGCGAGCTACTACACCGGTTGGGAGGAGTCCTGTGACTTC
ACCGGTGAGGGCTTCACAACGTGGTGAGGCGGTGGGGGTTGTGATGGAGACGGTGACGGAGGTTAG
GAGGGTAGAGAGTAATAATAGTGAGAAGGTTAATGGTTTTGTGGAGAGTAAGAAGGCTATGAGTGC
TATGGAAGCTCGAGCCATGGCTTGGGATGAAGCAGAACGTGCTAAATTCATGGCTAGGTATAAGAG
AGAGGAAGTGAAGATACAAGCTTGGGAGAATCACGAGAAGAGAAAGGCTGAGATGGAGATGAAGAA
AATGGAGGTGAAGGCGGAGAGGATGAAAGCAAGGGCAGAGGAGAAGTTGGCCAACAAGCTAGCTGC
GACGAAAAGGATAGCGGAAGAGAGGAGGGCGAATGCGGAGGCTAAGTTAAACGAAAAGGCGGTGAA
GACATCGGAGAAAGCTGATTATATAAGGAGGAGTGGTCACTTGCCTTCTTCTTTTTCTTTCTCCTT
TAAGCTTCCCTCTCGTTGTTGGTGTCAATAATTGTCTATTTTCATTAGAATGTAATCGTATGGATT
TAGTGATATTCAATAACTAACGCAAAAAAAAAAAAAAGTTTT

FIGURE 22 (continued)

SEQ ID NO: 229 - Arabidopsis thaliana - protein
MRSSVEDNKGWIGPATPEISNGFEFQKGSNRTPNHHRSTMGKPAPSKWDDAQKWLSGVGFARGGGG
GGDKSSHHSRSNKPRNSNADDLRLIASASQREREGEDQYVEYDDEEMAAGRPEVETKNVDCGESVW
RKESSINPTAVIRSVCVRDMGTEMTPIGSQEPSRTATPVRATTPVGRSPVTSPVRASQRGEAVGVV
METVTEVRRVESNNSEKVNGFVESKKAMSAMEARAMAWDEAERAKFMARYKREEVKIQAWENHEKR
KAEMEMKKMEVKAERMKARAEEKLANKLAATKRIAEERRANAEAKLNEKAVKTSEKADYIRRSGHL
PSSFSFSFKLPSRCWCQ

SEQ ID NO: 230 - Arabidopsis thaliana - DNA
ATGGATAATTTGGTTAAGCAAAGAAGAAGAAGGGTCTCAATCTCTGAGAACATAAAAACGGATTTG
CCAATGCTATCAGAATTGGACATAACAGATTACCCAGCATTAAACTGGCTGAAAAACCAATCATAT
TGGTACGAGAAAAATGACTACTACAACGAGAAAGAGAGTGAATTGGCAGTTTCTGTTGCGGTTGCT
GCATTCGTCATTAGATCAATGGAAGAAGCCGATAAACAAAAATCGAAAAGAATAAGAGAAGAAATC
AAGAGGTCAAGGACCAAAAAATCCAATCTGGTTATACCTAATACCCAAGTAAAGAGGTTAAGCAAA
TCATATACACAAGAGGTGAAAATTGGAGAGGAGAGTTTCAGAAAAAAATTGTTGGAGTATCCATCA
GAAAACCGTCGGCCACAAGAGATTGGCTCATCCTCCGGAACATCAGGACTTGCTTCAGCGTCAAGT
AAAGCAGATTCTTGGGAAAAATCTCAAATCAAGAAAATAAGATTAAGGTATGAGAAAATGAAAGCT
GATATTGTGGGTTGGGAGAATGAGAGAAAATTAGCAGCTACACTGTTAATGGAGAAAAGAAAGAGT
GAATTGGAGAAGAGAAAAGGGATTAATAATCAGCATTATAAGTCAAAATTAGCAAGGATTCAACTA
ATAGCTGATGGAGCCAAGAAACAGCTTGAGGAGAAGAGAAGGAGCAAAGAAGCTCAAGTTCATGGA
AAAGTAAAGAAAATGAGTCGAACAGGGAAAGTTCCTAATAATTATTTCTGCTTTCGGTGTTACTAA

SEQ ID NO: 231 - Arabidopsis thaliana - protein
MDNLVKQRRRRVSISENIKTDLPMLSELDITDYPALNWLKNQSYWYEKNDYYNEKESELAVSVAVA
AFVIRSMEEADKQKSKRIREEIKRSRTKKSNLVIPNTQVKRLSKSYTQEVKIGEESFRKKLLEYPS
ENRRPQEIGSSSGTSGLASASSKADSWEKSQIKKIRLRYEKMKADIVGWENERKLAATLLMEKRKS
ELEKRKGINNQHYKSKLARIQLIADGAKKQLEEKRRSKEAQVHGKVKKMSRTGKVPNNYFCFRCY

SEQ ID NO: 232 - Arabidopsis thaliana - DNA
GTCTCGTTTGTTTTGCTCTTTAGAAATTACCGATTTACGCTGAAAAAATGTGAAAAATACAATCGA
TCGCATTATCTTTATCCCTAGCTAATCATTCATGTACAAGCATGTCTCCGAAGGTTAAAAGCAGTC
GCTATTTACCGGACCAACGTAGTTTTCTCGAAGTGGTGGTCCGTTGTCATATTTTAAATTTATCAC
CTTCTTGAGAATTCCACATTTTTATCCTTTTGTCATGTAGTGTATATTTTTTCCTCTAACCTAAT
TAAAATCAAAACAAAATCCTTTGACCCAATTAGCTTCGCGATATATCAGAAGAGATCAAACTACTT
TGATCAGACCATGATCTTCTTCTTCTTCTTCTTCTTCTTCTTCTTCTTTTTAGACGATCACAATTC
CTAAACCCTATTTCTCAGATTATGCTGACTCTTTACCATCAAGAAAGGTCACCGGACGCCACAAGT
AATGATCGCGATGAGACGCCAGAGACTGTGGTTAGAGAAGTCCACGCGCTAACTCCAGCGCCGGAG
GATAATTCCCGGACGATGACGGCGACGCTACCTCCACCGCCTGCTTTCCGAGGCTATTTTTCTCCT
CCAAGGTCAGCGACGACGATGAGCGAAGGAGAGAACTTCACAACTATAAGCAGAGAGTTCAACGCT
CTAGTCATCGCCGGATCCTCCATGGAGAACAACGAACTAATGACTCGTGACGTCACGCAGCGTGAA
GATGAGAGACAAGACGAGTTGATGAGAATCCACGAGGACACGGATCATGAAGAGGAAACGAATCCT
TTAGCAATCGTGCCGGATCAGTATCCTGGTTCGGGTTTGGATCCTGGAAGTGATAATGGGCCGGGT
CAGAGTCGGGTTGGGTCGACGGTGCAAAGAGTTAAGAGGGAAGAGGTGGAAGCGAAGATAACGGCG
TGGCAGACGGCAAAACTGGCTAAGATTAATAACAGGTTTAAGAGGGAAGACGCCGTTATTAACGGT
TGGTTTAATGAACAAGTTAACAAGGCCAACTCTTGGATGAAGAAAATTGAGAGGAAGCTAGAGGAG
AGAAAAGCAAAAGCGATGGAGAAAACGCAAAACAATGTGGCGAAAGCGCAGAGGAAAGCGGAGGAG
AGAAGAGCGACGGCAGAGGCAAAGAGAGGGACAGAGGTTGCAAAGTAGTTGAAGTTGCTAATCTC
ATGAGAGCCCTTGGACGTCCTCCTGCCAAACGCTCCTTCTTCTCTTTCTCCTAATTTTTAGTTATA

FIGURE 22 (continued)

TCAAACCATTAAATTAAACAGTACTCGTTATATATCTAGTTAGTAAACAAGGGGCAGTTTTATAG
CTCATGTACACATAATTGAGAGTGTAGTACTGTTGTGTCATGTGTGGTTTTGTACTTTTCTTAGTT
ACACACACCATACAAGAAAAAAGAAGATTATAATTCAACTTAATTTTGATTTTTGAATAATGCGT
TTGTATAAGAAGTCAAATAAAAAATTCGTTTCTACTTTCTACC

SEQ ID NO: 233 - Arabidopsis thaliana - protein
MLTLYHQERSPDATSNDRDETPETVVREVHALTPAPEDNSRTMTATLPPPPAFRGYFSPPRSATTM
SEGENFTTISREFNALVIAGSSMENNELMTRDVTQREDERQDELMRIHEDTDHEEETNPLAIVPDQ
YPGSGLDPGSDNGPGQSRVGSTVQRVKREEVEAKITAWQTAKLAKINNRFKREDAVINGWFNEQVN
KANSWMKKIERKLEERKAKAMEKTQNNVAKAQRKAEERRATAEAKRGTEVAKVVEVANLMRALGRP
PAKRSFFSFS

SEQ ID NO: 234 - Arabidopsis thaliana - DNA
ATGGATACCTTAATCAAGCAGACAAGGAGGAAGCATCCAGCTTCCCAGGAAAAAATTAGAGAGGTT
GGTAGCTCAACTAGAGAGAAAAAAGTGTCAGCAAGGAAGTCTGTTTCATTCAAAGAAGATAAGAAG
AAGCCTTCAAACTGGTTACAGAAGCAGTTCTCGAGGCAAATGAGTGGCCAAAGTTATGATCCCATC
GGAGAAATGGATCATGCAGCTGCAGTTGCAGCCACTGCCTATGCCATAGCCACTTTTGAAGAAACT
TGGCTAGAGAACTATCATAGTGGCCTTGAACTTGGACCTTCTTCGTCAAGGAGCAAGAGCAGAAGT
GAAGAACTGTTGCCTTTAGAGGAACCAAGAAGCTTATCAAGAAGATTCTCAGGGCAACTTTCGTTT
ATAGATTCAGAGACGAAAGATCATAAACCTCCTACACTAAAGTCCCCAATGAGAAAGTCATCTTCG
GTAAAAAAGACTTTCTCCATGAACTTGATGGGAGACCACACCAAACAGAATCAAGATTCAGAGGAG
AAACATGAAAGACAAAGAAAACCGGTTTCTGAACCACCACGGATACAACCACCGCTTAGGACACGA
TCAGAACCTCGTGCTCCACCGCCACCTCCTCCTCCTCTTCTATCACCTTCGCCTCTGCGGCTTCCA
CCTAGGGAAACCAAAAGGCAGAGTTCTGAGCATACTAGTCGAAAGGATGATTCTACAGCTGATGCT
TGGGAAAAAGCTGAACTATCTAAGATCAAAGCAAGGTATGAGAAGTTAAACAGAAAGATAGATTTG
TGGGAAGCGAAGAAAAGGGAAAAAGCTCGAAGGAAGCTGGACATATCTGAGCAGAGCGAACTAGAA
CAGAGGAGAAAGAGAGGTTTGCAGAGATTTAGAGAAGACACAGAATACATTGAACAGATTGCTGCT
GGAGCCAGAGCTCAGGCGGAGAAAGACAGACAGAGCAAAGAGTTCAAGGTGAAGGAGAAGGCCGGT
GTTATCCGTAGTACCGGTAAACTCCCTGGAAATGCATGCTGTTTCTGA

SEQ ID NO: 235 - Arabidopsis thaliana - protein
MDTLIKQTRRKHPASQEKIREVGSSTREKKVSARKSVSFKEDKKKPSNWLQKQFSRQMSGQSYDPI
GEMDHAAAVAATAYAIATFEETWLENYHSGLELGPSSSRSKSRSEELLPLEEPRSLSRRFSGQLSF
IDSETKDHKPPTLKSPMRKSSSVKKTFSMNLMGDHTKQNQDSEEKHERQRKPVSEPPRIQPPLRTR
SEPRAPPPPPPLLSPSPLRLPPRETKRQSSEHTSRKDDSTADAWEKAELSKIKARYEKLNRKIDL
WEAKKREKARRKLDISEQSELEQRRKRGLQRFREDTEYIEQIAAGARAQAEKDRQSKEFKVKEKAG
VIRSTGKLPGNACCF

SEQ ID NO: 236 - Arabidopsis thaliana - DNA
ATGAGAAAGACTTCTGTTTCATCTAATAGCTTTGGTGGGTTTTTAAGTCCCGGAGCTCCGAGTTAC
GCTGACAACAAAGGTTGGAGCTCCGAGAGAGTTCCTCATCCTTCCTCCACTACTTCCTCCTCTGCA
ATTAACGGTGGTCGTCGTCACATCGGCTCTTCTTCCGCTTTAACGACGCCGTTTTACAGCGGCAGA
GCAATTCCTTCGAAATGGGAAGATGCTGAGCGGTGGATTTGTAGCCCTGTGTCGACTTACCCACAA
GGTGTTTGTTTAAATTCCTCAGTGAGTTCTGAACAGAGAAGGCAGAAATCTAAAAGTGGTCCGATT
GTTCCTCCTACGTTGCCTCATCCGCATCCTACGTCTTCTTCGTCGGCGACTGGGTGTTATCACTAT
TCTCCGAGGATGATGATGCGGTCTATGGATGCTCCTCCTAAGGGTTTAATGGTTGCTGGTTCTCCG
TTTTCTACTGGAGTTTTGGAGGCGGATAGGGTTTTTAGAGGAAGTGTCGGTGGTGGTGGTTGTGAT
GGCTATGGTCGTGGACCTGGCCATGGACATAGCCGGAGCTGGGTTGATTTGATGAGTGAAGAAACT FIGURE 22 (continued)

```
TCTTCACTTAGCTCCAAAACTGATACAGAGGAGAAAGCAGAGATGACGACGGCGATGCAATCTCCG
GTGGTATCAAGAAGAGATATGGCTACTCAGATGAGTCCAGAAGAGACGAGTCCTAATAACAATAAC
CAGTCTCCACCATTGGTTGTTTCTGTGATTGAGCCACCTCCTTGTAGAGGTGAAGTGAGAGAAGTG
AAAATGGATAAAGGAGCAAGAATGATTAAGCGTCCAAAGAGACGAGTCATGTCTTCTAGGATTATT
AGGAGAGAGCAACCTGAGGTTGAAGACAATTCTGAAGCTTCTGCTTCTTCTTCTTCTTGGGATATC
TCAGAACCAGCCATGACTCTTTCTAAGTTGCAAAGAGAGGAAGCGAAGATTGCAGCTTGGGAAAAT
CTGCAGAAGGCGAAAGCAGAAGCCGCTATTAGAAAACTTGAGGTGAAGCTGGAGAAGAAGAAATCA
GCATCAATGGATAAGATCTTGAACAAGCTTCAAACAGCTAAGATCAAAGCACAAGAGATGAGGAGA
AGTTCAGTATCCAGTGAACATGAACAACAACAAGGGAATCATCAAATCTCCAGAAACTCGGTGAAG
ATCACGCATCTTGTTCGAAGACATACTTTCATGACTCCTTTCATGACTTGCTTTGCTCCTCGTGTT
GATTGCAGAAAATCTTCTTCTGCTCTCTGA
```

SEQ ID NO: 237 - Arabidopsis thaliana - protein
```
MRKTSVSSNSFGGFLSPGAPSYADNKGWSSERVPHPSSTTSSSAINGGRRHIGSSSALTTPFYSGR
AIPSKWEDAERWICSPVSTYPQGVCLNSSVSSEQRRQKSKSGPIVPPTLPHPHPTSSSSATGCYHY
SPRMMMRSMDAPPKGLMVAGSPFSTGVLEADRVFRGSVGGGGCDGYGRGPGHGHSRSWVDLMSEET
SSLSSKTDTEEKAEMTTAMQSPVVSRRDMATQMSPEETSPNNNNQSPPLVVSVIEPPPCRGEVREV
KMDKGARMIKRPKRRVMSSRIIRREQPEVEDNSEASASSSSWDISEPAMTLSKLQREEAKIAAWEN
LQKAKAEAAIRKLEVKLEKKKSASMDKILNKLQTAKIKAQEMRRSSVSSEHEQQQGNHQISRNSVK
ITHLVRRHTFMTPFMTCFAPRVDCRKSSSAL
```

SEQ ID NO: 238 - Arabidopsis thaliana - DNA
```
CAACAGTGGTAGAAACAAAACAAAAGAAAACTCCATGGACTTCACAAGAAACAGCAACACCAAGCT
CCATCCCCAAACTCAGCTTCTGTTTCCCCCTAATATGGAGAAAAACTCAAATGTTAGCGCCAACCC
ATTTGCAGAAGACTCACTTACAAGCAGAATCAATCTAAAGGAAACTACAGATTTCATCAAGTCACT
TCCAATTTCATCAAACCAAAGCAGTAGTAGCAGCAATGAGATGGTAAACGAGAGAAGACCAAGTTT
CTCATCACAAAAGAGCATTGGAGAAGGAAGAAGCAATGGACAAAGAAGATTGATGTTAATGGAGTC
TCCTTGTACTCCAGGTAGAGGAGTCTTCAGTTTCAGTAGCAATGTCTCTGGTAGAAGAAGAAACTT
CCCTTCTAAATGGATTGATGCTGAGAAATGGGTCACTTCCTCTGGTCATGACTCTCCAGCACATTC
TCTCAAAAACAACCAATTTGATGGGTTTAAACACCAGGTGGAAGTTGTATACTCAGAGAAATCTAG
GGTTACAGAAGAATGTTTCCATGGATCTGTCTCATTATCTCCACAAGATCTTATCCTTAAAGATAA
GTTAGCAAACGAAGTTCCTCAGATTCTTCCATCAACGGAAGGGTTTATATTCAAAGATTCCGACAA
GTTTCTCCGGTACGAGGAAGCTCAAGTTCAACACAGAGACATGGGAACAGAGATGACACCAATAGG
AAGTGTAACGACTTCAAGATGTCACACGCCGTTTAAAAGTTCCTCTCCAGCGAGACACAACACGCC
TTCTCAATTGTCTGGTCCGTTAACGGAAACCAAAAACGTTATAGATATATCCGAGTTCGAAGACAA
GCTTAGACTCAGTGGGTCATCAACGAGTCAGTATTGTTACTCGGTGACGAGTCATTGGAACTCGAG
AGAAGAAGAAGAAGAGATATCGAAGAGTTTAAGACATTTCGATATGGAGAGTGAGTTAAGGAG
AAGTGTGTCTGAATCTAAAGCTCCTTTATGGGATGATGAAGACGACAAGATCAAGTTTTGTCAAAG
GTATCAAAGAAGAGGCCAAAATTCAAGCATGGGTTAATCTTGAAAACGCTAAAGCCGAAGCTCA
ATCTAGAAAGCTTGAGGTGAAAATACAGAAGATGAGATCAAATTTAGAGGAGAAATTAATGAAGAG
AATGGATATGGTGCACCGGAGAGCAGAAGATTGGAGAGCTACGGCGAGGCAGCAACATGTTGAGCA
GATGCAGAAAGCGGCCGAGACGGCGAGGAAATTGACAAACCGCCGAGGCTATTTGGTTACCGGCCG
TAGCTCATGTGGTTGTCTACCTTGCAATAATACTTGTCATTAACTCAGTCAAAGTAAAAGAGAGTA
AAATACACATAAACAAACACAAGAAATTACTGTTT
```

SEQ ID NO: 239 - Arabidopsis thaliana - protein
```
MDFTRNSNTKLHPQTQLLFPPNMEKNSVSANPFAEDSLTSRINLKETTDFIKSLPISSNQSSSSS
NEMVNERRPSFSSQKSIGEGRSNGQRRMLMESPCTPGRVFSFSSNVSGRRRNFPSKWIDAEKWV
TSSGHDSPAHSLKNNQFDGFKHQVEVVYSEKSRVTEECFHGSVSLSPQDLILKDKLANEVPQILPS
```

FIGURE 22 (continued)

TEGFIFKDSDKFLRYEEAQVQHRDMGTEMTPIGSVTTSRCHTPFKSSSPARHNTPSQLSGPLTETK
NVIDISEFEDKLRLSGSSTSQYCYSVTSHWNSREEEEEEISKSLRHFDMESELRRSVSESKAPLWD
DEDDKIKFCQRYQREEAKIQAWVNLENAKAEAQSRKLEVKIQKMRSNLEEKLMKRMDMVHRRAEDW
RATARQQHVEQMQKAAETARKLTNRRGYLVTGRSSCGCLPCNNTCH

SEQ ID NO: 240 - Arabidopsis thaliana - DNA
CCATTTTGTCTCTCTTCTTCTTTTTCAGAGACAGAGGAATTAGAGAAAGCAAGCTTTGTGTCTGTA
AATATAAAGAGATAGAGAAAAGATTTGGCATTGGCAATGGATTACGAGAGGATACAGAAAGTGCAG
AAGAGTATAATCTCGCCAACGAAGCTGAGAATGAAGCTAATGGGTCCACTCAATAACATGAAGCGA
GAAGGATCCAAGTCCAACAGTAACTCTTCAAGAACATCTCCTTCTCGTCTTCAGATTCCAGATGAC
TCCGAGTTCTCCAAGAACAGCTTGTTAGCTTCTAACTCTTATTCAGACGACGATGTGGCAGCTACA
ACTACGGATATAGAAGTAGCTAAGCTGCCAAATGAGCCGGTTTTGTATCCAACCGAGAACGATAAT
CAAGGCTCAAAAGATCGGTGTGAAGGTGTTGTTCCAAGGGAAAATGATCAGCCTAGACTGCAGCAA
TTTAGGAAAGGGGACTTGAATATGGCTTCTCCTCATATAATGAGACCTCAAGAAGATGAAAACCTT
GATTATGACAGTAACGCTAGCTCTTCAAGCTTCGAGTTTCACCGAGCTCGTGGTGAGCGTTCGAAT
CAGAATCATGGCTCAAGAGGATATCCTTCAAGACAAATGCCATCTAAATGGAATGATGCTGAGAAG
TGGATAATGAGCAGACAGAACATGGTGATGAGGAAGAACGGTCAAGGGAACCGAATACCTGTGAGA
ATTGTGCCTGATAATGCAGGTTACGAGCATAACAAATCTAGGATGGATCTGTGCCAATCCTCACAA
GTTGATGGGTTTGAGAAGTTCCCTAATGTTGTTCCCTCGGCGCCACATCCTATTCTAACTCAAGAG
TATGGAGGAGACTCGTTGATTGACCAATCCACACAAAGCAATGATCTTGCGGATTCATCACATGAT
CATACAACAGGTGGTCCTGCGATTCGTTCGGTATGTATGAGAGATATGGGAACCGAAATGACACCT
ATACCGAGTCAAGAACCTTCAAGATCTGTGACACCAGTTGGTGCAACAACTCCTCTTCGTAGCCCG
ACTTCATCTCTCCCTTCTACTCCTAGAGGTGGCCAACCAGAGGAATCTTCTATGTCGAAAAACACA
AGAAGAGAACTATCTGAGGAGGAAGAGAAAGCGAAGACGCGAAGAGAGATTGTAGCTCTTGGAGTT
CAGCTAGGGAAGATGAACATCGCCGCTTGGGCAAGTAAAGAAGAAGAGGAGAACAAGAAAAACAAT
GGAGATGCAGAGGAGGCACAGAAGATTGAGTTTGAAAAACGAGCGACTGCATGGGAAGAAGCAGAG
AAATCCAAACATAATGCGAGGTATAAGCGTGAGGAAATCAGAATCCAAGCTTGGGAAAGTCAGGAG
AAAGCCAAACTCGAAGCAGAAATGCGACGTATAGAGGCTAAAGTTGAGCAGATGAAAGCTGAAGCT
GAAGCAAAGATAATGAAGAAAATTGCGTTGGCTAAGCAAAGGTCAGAAGAGAAACGGGCTTTGGCG
GAAGCTAGAAAAACCCGTGATGCTGAGAAGGCAGTGGCTGAAGCCCAATATATTCGGGAAACTGGT
AGAATACCGGCATCAAGTTACAAGATATGTTGTGGTTGGTTCTCATGAGGCATTGGATTGAGTTTT
TGGTCTTCTGAGTAAACCATGATTGGATTCTCAAAGCCCCTTTGTGTAATATAGAAATGGAATGCA
TATTATGTTGCATAGACT

SEQ ID NO: 241 - Arabidopsis thaliana - protein
MDYERIQKVQKSIISPTKLRMKLMGPLNNMKREGSKSNSNSSRTSPSRLQIPDDSEFSKNSLLASN
SYSDDDVAATTTDIEVAKLPNEPVLYPTENDNQGSKDRCEGVVPRENDQPRLQQFRKGDLNMASPH
IMRPQEDENLDYDSNASSSFEFHRARGERSNQNHGSRGYPSRQMPSKWNDAEKWIMSRQNMVMRK
NGQGNRIPVRIVPDNAGYEHNKSRMDLCQSSQVDGFEKFPNVVPSAPHPILTQEYGGDSLIDQSTQ
SNDLADSSHDHTTGGPAIRSVCMRDMGTEMTPIPSQEPSRSVTPVGATTPLRSPTSSLPSTPRGGQ
PEESSMSKNTRRELSEEEEKAKTRREIVALGVQLGKMNIAAWASKEEEENKKNNGDAEEAQKIEFE
KRATAWEEAEKSKHNARYKREEIRIQAWESQEKAKLEAEMRRIEAKVEQMKAEAEAKIMKKIALAK
QRSEEKRALAEARKTRDAEKAVAEAQYIRETGRIPASSYKICCGWFS

SEQ ID NO: 242 - Arabidopsis thaliana - DNA
ATGCCGTCGGAGTCATCGTACAAAGTCCACCGTCCGGCGAAATCCGGAGGATCTCGACGAGACTCA
AGCCCCGACTCAATAATCTTCACACCTGAATCTAATCTCAGTCTCTTCTCCTCCGCTTCCGTCAGC
GTCGATCGTTGCTCTTCCACCTCCGACGCTCACGACCGGGACGACTCTCTCATCTCCGGTCCCTCT

```
CTGGAGCGAGATCAGAGGGTAAGTTCGAGCTGTAAAGATCTAGATCTAGACAAGCGTGGTACAGGG
TGGAAGAATAGTTGTAACTCTAGAAAATCAAATAAAGTAAAAGCAGCTTGGAAAGAGGAGTTTGAG
GTTAAAAAAGATGATGAAAGCCAGAATCTTGATTCAGCTAGGAGTTCTTTCTCTGTAGCTCTTAGA
GAATGTCAGGAACGAAGATCTAGATCTGAAGCGCTGGCGAAAAAGTTAGATTACCAAAGGACTGTT
TCGTTGGATCTTAGTAATGTAACCTCTACGTCTCCAAGAGTGGTAAATGTGAAGAGAGCTTCAGTT
TCAACTAATAAATCGAGTGTGTTTCCTAGTCCTGGTACTCCGACTTATCTACATAGTATGCAAAAG
GGTTGGAGTTCAGAGAGAGTACCTTTACGTTCAAACGGAGGAAGAAGTCCGCCAAATGCTGGGTTT
TTACCTTTGTATAGTGGTAGAACGGTTCCTTCTAAGTGGGAAGATGCGGAGAGATGGATAGTTAGT
CCTCTTGCTAAGGAAGGAGCTGCCCGTACTTCATTTGGAGCATCGCATGAAAGGCGACCTAAAGCA
AAGAGTGGTCCATTAGGTCCTCCAGGATTTGCATATTATTCGTTGTATTCCCCTGCAGTTCCTATG
GTTCATGGTGGAAACATGGGAGGCTTAACAGCAAGCTCTCCGTTTTCAGCTGGTGTGTTGCCAGAA
ACTGTTTCTTCTAGGGGTTCCACTACAGCTGCCTTTCCTCAGCGAATCGATCCATCCATGGCGAGA
TCAGTTAGCATTCATGGCTGCTCTGAAACACTTGCATCTTCATCCCAAGATGACATCCATGAAAGT
ATGAAGGATGCTGCTACCGATGCTCAAGCTGTCTCAAGAAGGGATATGGCAACCCAGATGAGTCCC
GAGGGAAGCATCCGGTTTTCCCCTGAGAGACAGTGTTCGTTCTCTCCCTCCTCCATCACCACTA
CCTATTTCGGAACTACTGAATGCTCATTCCAACCGAGCAGAAGTCAAGGACTTACAGGTTGATGAG
AAGGTAACCGTAACTCGCTGGTCAAAGAAGCACAGAGGTCTATACCATGGAAATGGCTCAAAAATG
CGAGATCACGTACATGGAAAAGCTACTAACCATGAAGATTTGACATGTGCGACAGAGGAAGCCAGA
ATTATATCTTGGGAAAATTTGCAGAAAGCTAAGGCCGAGGCAGCAATAAGAAAGCTAGAGAAATAT
TTCCCACAGATGAAGCTGGAAAAGAAAAGATCATCGTCGATGGAAAAGATTATGAGAAAAGTAAAA
TCAGCAGAGAAGAGAGCGGAGGAGATGAGGAGGTCGGTGTTAGACAATAGAGTCTCAACCGCATCT
CATGGTAAGGCTTCATCATTCAAAAGAAGTGGGAAGAAGAAGATCCCTTCCCTTAGTGGTTGCTTC
ACCTGCCATGTATTCTAGTTGCCCTTTTTCGAAGAAAATACGGTAAATGGAGACTCTTCACTGATG
CGTACGCGTAATATTTGGCTTTCTAATTCCTGCTTGTAATACTACTTTCGATAGTCAGTAGCTGTT
AATTGATTTCAATAGATGCGCTTAGTACATTTGTATGTTAGTTCCTAGCTGAGTAAAATCCGAGGG
ATGAGTCCACCCATTTCCACCTTTGTTGGTCTCTTCGGGTGTTTAGAGGTGAATTGATCCCAAGAG
GACAAACTCTTCTTGATAAAATGTATTTGTAATTTATGATGCCTTGATACTAACATTATGACATAA
CTTTTTTTAACATTATGACAAACATTGTTGTTTTACATTC
```

SEQ ID NO: 243 - Arabidopsis thaliana - protein
```
MPSESSYKVHRPAKSGGSRRDSSPDSIIFTPESNLSLFSSASVSVDRCSSTSDAHDRDDSLISGPS
LERDQRVSSSCKDLDLDKRGTGWKNSCNSRKSNKVKAAWKEEFEVKKDDESQNLDSARSSFSVALR
ECQERRSREALAKKLDYQRTVSLDLSNVTSTSPRVVNVKRASVSTNKSSVFPSPGTPTYLHSMQK
GWSSERVPLRSNGGRSPPNAGFLPLYSGRTVPSKWEDAERWIVSPLAKEGAARTSFGASHERRPKA
KSGPLGPPGFAYYSLYSPAVPMVHGGNMGGLTASSPFSAGVLPETVSSRGSTTAAFPQRIDPSMAR
SVSIHGCSETLASSSQDDIHESMKDAATDAQAVSRRDMATQMSPEGSIRFSPERQCSFSPSSPSPL
PISELLNAHSNRAEVKDLQVDEKVTVTRWSKKHRGLYHGNGSKMRDHVHGKATNHEDLTCATEEAR
IISWENLQKAKAEAAIRKLEKYFPQMKLEKKRSSSMEKIMRKVKSAEKRAEEMRRSVLDNRVSTAS
HGKASSFKRSGKKKIPSLSGCFTCHVF
```

SEQ ID NO: 244 - Arabidopsis thaliana - DNA
```
CTGTACTTTCACAAGCTTCCAAGCTCTCTTATCATTCACTGATTTTTGGTTCTCGAGAAAAAAGTG
AAGATTTTTGAGATTCTCTTTCGATGGATTACGAACGAATCGGAAAGACCCAGGTTACTAGTAGCG
GCGGCGGATTTTCTCCGGGGAAGTTAAGGAGTATGCTTCTTCTAGGTGTTGATAGAAAGAAGAATG
AAGAAGAAGAATCAACTCCTACAATGAGATCTGGGTCTAATCAAATTGATGACCCTAGGGTTTATG
TTGCTAGTGGATTAGATGATTGCAAAGATGTTGATGTTGTGAGTGAGATTACTGATTGTTCTACTT
CAGGGATAGCTAGATCGATTAGTTTGGGTCTTCAAGAGTATTCTGATTATGATAATGTGAATGAGA
TCAAGAGTGTTTCTGCATCATCTGTCTTTGAGTTTCAAAAGACTGAGAAGGAAAAAGTTAATCAAA
```

FIGURE 22 (continued)

```
GAATGCCTATTAGATCATTCTCTAAACCAGCTCCATCTAAATGGGATGATGCTCAGAAATGGATTG
CTAGTCCTACGGCTAACCGACCGAAGACTGGACAGGTTCAGGTTCCGGGTTCGAAGAAAGGGCCTA
GCTTTGGTCGTCAGTCTTCTATGAAGATTGTTGAAGTTGCTGAACATAGAGTGGTTGAAGAGCCTG
ATACAAAGAGAATAGATGTAAGCCAAGTGAAAAGGATATGGGAAACAAGTTTGGTAGCTGGGAAG
TTGATTCGTACACTACCGTGGATTCATATGTCAAACCGGTTCTTATGGTTGAGAACTCTATTGTAG
AATCAGCAACTGAAGTTAATCTCAGCCGTCATGACTCGTCAGTCGCAACTGCGTTTGCTCAACCGC
CTTCAACGGCAAGGTCTGTGTCAATGAGAGACATGGGAACTGAAATGACTCCTATAGCGAGCCAAG
AACCTTCTAGAAACGGGACACCGATTAGGGCAACAACGCCAATACGAAGTCCTATATCTTCTGAAC
CTTCAAGTCCAGGCAGACAAGCATCAGCTTCTCCTATGAGTAACAAGGAACTGTCAGAGAAAGAGC
TTCAAATGAAAACTAGGAGAGAGATAATGGTGTTGGGTACTCAACTTGGTAAATTTAACATTGCTG
CTTGGGCTAGCAAGGAGGATGAAGATAAAGACGCATCCACATCATTAAAGACCAAAGCTTCTCTAC
AAACTTCTAAAAGTGTTTCTGAAGCTCGTGCTACAGCGTGGGAGGAAGCGGAAAAAGCTAAGCACA
TGGCTAGGTTCAGACGCGAAGAGATGAAGATTCAAGCATGGGAGAATCATCAGAAGGCGAAATCTG
AAGCCGAGATGAAGAAAACCGAGGTTAAAGTTGAGAGGATTAAGGGACGAGCACAAGACCGGTTGA
TGAAGAAACTCGCTACAATCGAGCGCAAAGCAGAGGAAAAGCGAGCAGCGGCTGAAGCAAAGAAGG
ATCATCAGGCAGCTAAAACAGAGAAACAAGCTGAACAAATCCGAAGAACAGGCAAAGTACCTTCAT
TGTTGTTCTCTTGCTTTAGCTTTTGTTCTTAAATCCAATCCTATTGTGAATGTGATGTTGTTAATT
CTCAAGAACACATCTTTCTATCATCATTTGTATAATAAAAGCTTTGAAAAACTTATTTCTTGTGAT
CT
```

SEQ ID NO: 245 - Arabidopsis thaliana - protein
```
MDYERIGKTQVTSSGGGFSPGKLRSMLLLGVDRKKNEEEESTPTMRSGSNQIDDPRVYVASGLDDC
KDVDVVSEITDCSTSGIARSISLGLQEYSDYDNVNEIKSVSASSVFEFQKTEKEKVNQRMPIRSFS
KPAPSKWDDAQKWIASPTANRPKTGQVQPGSKKGPSFGRQSSMKIVEVAEHRVVEEPDTKRIDVS
QVKKDMGNKFGSWEVDSYTTVDSYVKPVLMVENSIVESATEVNLSRHDSSVATAFAQPPSTARSVS
MRDMGTEMTPIASQEPSRNGTPIRATTPIRSPISSEPSSPGRQASASPMSNKELSEKELQMKTRRE
IMVLGTQLGKFNIAAWASKEDEDKDASTSLKTKASLQTSKSVSEARATAWEEAEKAKHMARFRREE
MKIQAWENHQKAKSEAEMKKTEVKVERIKGRAQDRLMKKLATIERKAEEKRAAAEAKKDHQAAKTE
KQAEQIRRTGKVPSLLFSCFSFCS
```

SEQ ID NO: 246 - Arabidopsis thaliana - DNA
```
ATGGAGCCAAATATTCCGATCCAAAGAGGTAACTCATATCACAGAGTTTTAGTATTGTTTAGTTTC
ATGTTGACTCAGAAGAAGCTACTAGATATTTCAGGATGGGAGAAAAGAAAACTACAAAGATCGAA
TCTGAACTCGCTAGAATTCAGCGGAAGATGGACAGTAAGAAGATGGAGAAATCTGAGAAACTAAGG
AACGAAAAGCGGCAGTTCATGCAAAGGCACAAAAGAAGAAGGCAGATGTTCAAACCAGACGGGCT
CAAGAGATCCTTGATGCGGAAGAAGCTGCTGCTAGGTTTCAAGCCGCAGGAAAGATACCCAAGAAG
TCATCTTTGAGCTGCTTCTGA
```

SEQ ID NO: 247 - Arabidopsis thaliana - protein
```
MEPNIPIQRGNSYHRVLVLFSFMLTQKKLLDISGWEKKKTTKIESELARIQRKMDSKKMEKSEKLR
NEKAAVHAKAQKKKADVQTRRAQEILDAEEAAARFQAAGKIPKKSSLSCF
```

SEQ ID NO: 248 - Arabidopsis thaliana - DNA
```
ATGAAGACTAACCGGAACCGTCCGATCAACATCCTCATCGTCTTCTTCCTTCTTACGACCGCAAGA
GCAGCAACAAGAAACTGGACCAACCGAACTCACCGAACCGTCCCTAAGGTTCAACACGCGTACTAC
GCATATCCTCACCGTTCATGCGAATCTTTCTCGTCCATACGCACGCTCTATGTGCATTGAGCTC
GAAAGAATCCACAGAAGCAGTCGACAACCGCTTTTCTCCTCCGCCTCCTCCGACGGAGATTGAT
CAAAGCGTCATGAACGAATCCACAGTGCAACGAGCGAAACCTGAACATATGGCAGCTGTTGTGGAT
```

FIGURE 22 (continued)

CAATGGAAGGAAACAGAGATAAGCAAATCGAGAAAGAAGTACGAGAAGCTAAGTGAGAAGATTGTG
TCATGGGAAGATAAGAAGAGGAAAAAGGCAAAGAGAAAACTTCATAGAACAGAGAGAAGTGTAGAG
AAAACAAAGTTGAAGGCGACCCAGAGGTTCAGGGACGAAAATGAACGTATTGAGATTATCGTTGCA
AGTGCAAGAGCACATGCGTATGAGAGTCGAATAAAAGAAGAGTTGAAGGTTAAGGAGAAAGCAAAC
CTCATGAGAACAACTGGTAGGAAACCCTCTACATGCCTCTGA

SEQ ID NO: 249 - Arabidopsis thaliana - protein
MKTNRNRPINILIVFFLLTTARAATRNWTNRTHRTVPKVQHAYYAYPHRSCESFSRPYARSMCIEL
ERIHRSSRQPLFSPPPPPTEIDQSVMNESTVQRAKPEHMAAVVDQWKETEISKSRKKYEKLSEKIV
SWEDKKRKKAKRKLHRTERSVEKTKLKATQRFRDENERIEIIVASARAHAYESRIKEELKVKEKAN
LMRTTGRKPSTCL

SEQ ID NO: 250 - Arabidopsis thaliana - DNA
ATGAAGACTAACCGGAACCGTCCGATCAACATCCTCATCGTCTTCTTCCTTCTTACGACCGCAAGA
GCAGCAACAAGAAACTGGACCAACCGAACTCACCGAACCGTCCCTAAGGTTCAACACGCGTACTAC
GCATATCCTCACCGTTCATGCGAATCTTTCTCTCGTCCATACGCACGCTCTATGTGCATTGAGCTC
GAAAGAATCCACAGAAGCAGTCGACAACCGCTTTTCTCTCCTCCGCCTCCTCCGACGGAGATTGAT
CAAAGGTACGAGAAGCTAAGTGAGAAGATTGTGTCATGGGAAGATAAGAAGAGGAAAAAGGCAAAG
AGAAAACTTCATAGAACAGAGAGAAGTGTAGAGAAAACAAAGTTGAAGGCGACCCAGAGGTTCAGG
GACGAAAATGAACGTATTGAGATTATCGTTGCAAGTGCAAGAGCACATGCGTATGAGAGTCGAATA
AAAGAAGAGTTGAAGGTTAAGGAGAAAGCAAACCTCATGAGAACAACTGGTAGGAAACCCTCTACA
TGCCTCTGA

SEQ ID NO: 251 - Arabidopsis thaliana - protein
MKTNRNRPINILIVFFLLTTARAATRNWTNRTHRTVPKVQHAYYAYPHRSCESFSRPYARSMCIEL
ERIHRSSRQPLFSPPPPPTEIDQRYEKLSEKIVSWEDKKRKKAKRKLHRTERSVEKTKLKATQRFR
DENERIEIIVASARAHAYESRIKEELKVKEKANLMRTTGRKPSTCL

SEQ ID NO: 252 - Arabidopsis thaliana - DNA
ATGGCGGAGGAACAGAAGATAGCGTTAGAATCAGAATCTCCGGCGAAGGTTACGACTCCTGCTCCA
GCAGATACACCGGCTCCAGCTCCGGCAGAGATTCCGGCTCCAGCTCCAGCTCCGACTCCGGCTGAT
GTCACGAAAGACGTTGCAGAGGAGAAAATTCAAAACCCACCTCCGGAGCAAATTTTCGATGACTCC
AAAGCCCTTACTGTTGTTGAGAAACCTGTAGAAGAGCCTGCACCGGCGAAACCTGCGTCTGCATCG
CTCGATAGAGATGTTAAGCTAGCTGATTTGTCAAAGGAAAAGAGATTGTCTTTCGTCAGAGCGTGG
GAAGAAAGCGAAAAGAGCAAAGCAGAGAACAAAGCTGAGAAGAAGATTGCAGATGTTCATGCTTGG
GAAAACAGCAAGAAAGCAGCTGTCGAAGCGCAACTCAAGAAAATCGAGGAGCAACTAGAGAAGAAG
AAAGCAGAGTATGCAGAGAGGATGAAGAATAAGGTTGCAGCGATTCACAAGGAAGCAGAAGAGAGA
AGAGCAATGATTGAAGCTAAGCGTGGAGAAGACGTTCTTAAAGCAGAAGAAACGGCTGCTAAATAC
AGAGCCACTGGAATTGTTCCAAAGGCAACTTGTGGATGTTTCTAA

SEQ ID NO: 253 - Arabidopsis thaliana - protein
MAEEQKIALESESPAKVTTPAPADTPAPAPAEIPAPAPAPTPADVTKDVAEEKIQNPPPEQIFDDS
KALTVVEKPVEEPAPAKPASASLDRDVKLADLSEKERLSFVRAWEESEKSKAENKAEKKIADVHAW
ENSKKAAVEAQLKKIEEQLEKKKAEYAERMKNKVAAIHKEAEERRAMIEAKRGEDVLKAEETAAKY
RATGIVPKATCGCF

FIGURE 22 (continued)

SEQ ID NO: 254 - Arabidopsis thaliana - DNA
ATGACTTTAGAGGAGCAGAAGAAAGTCATAATGCCCGAGGCCGTCGCATCGGAGCCATCACCACCA
TCCAAGGAGGAGAAGTCCGACGATTCGAAAGCTATTGTTCTCGTCGTCGCTGCAAAAGAACCTACG
GAAGACAAGAAAGTAGGTTCAGTTCACCGAGATGCTGTTTTGGTTAGACTCGAGCAAGATAAGAGG
ATATCTCTAATCAAAGCTTGGGAAGAGGCTGAGAAATCCAAAGTGGAGAACAAAGCTCAGAAGAAG
ATTTCTTCAGTTGGAGCTTGGGAAAACAGCAAGAAAGCTTCTGTGGAAGCTGAGCTAAAAAAGATC
GAGGAGCAACTAAATAAGAAGAAAGCACACTACACAGAGCAAATGAAGAACAAGATAGCTCAAATC
CACAAGGAAGCTGAGGAGAAGAGAGCGATGACCGAAGCTAAACGCGGAGAAGATGTTCTCAAAGCC
GAAGAAATGGCTGCAAAGTACCGTGCCACCGGAACTGCTCCAACCAAGCTATTTGGATTCTTCTGA

SEQ ID NO: 255 - Arabidopsis thaliana - protein
MTLEEQKKVIMPEAVASEPSPPSKEEKSDDSKAIVLVVAAKEPTEDKKVGSVHRDAVLVRLEQDKR
ISLIKAWEEAEKSKVENKAQKKISSVGAWENSKKASVEAELKKIEEQLNKKKAHYTEQMKNKIAQI
HKEAEEKRAMTEAKRGEDVLKAEEMAAKYRATGTAPTKLFGFF

SEQ ID NO: 256 - Arabidopsis thaliana - DNA
ATGACGACGACGACAGAGCTTACTCGGCCACAACAAAGGGGATCAGGAGGAGGATACTTGTCTCCG
TCGAGGTCTATTGCTTTTAGCGACGGAACTACTTCTTCCGGTGAGAATTTCACCACCGTGAGCAGA
GAGTTCAACGCTCTAGTCATCGCCGGATCTTCCATGGACAACAACAGTAACGGAACTAACCAATCA
GGTGGTCATCGTGACGTCATACGTGATGAAAGAAACGAGCTGACTAGGATCGGCGAAAACGATGAC
GTTGGTGATCATGGTCAGGTGCCTGAGGAGGATTCAAATCCATGGGCGATTGTACCGGACGATTAC
AACAACCGGGACGGTTCAGAGAATAATATTGTGTTGGCGTCATCAGGTGGTCAGAACCGGATGGTG
ACGACTGCTTCGGTGCAGAGGGTGAAGAGAGAAGAGGTGGAAGCAAAGATAACGGCGTGGCAAACG
GCGAAGGTGGCTAAGATTAATAATAGGTTTAAGAGACAAGACGCCGTTATTAACGGTTGGTTGAAT
GAGCAGGTTCATAGAGCTAACTCTTGGATGAAGAAAATCGAGAGGAAACTGGAAGATAGGAGAGCG
AAGGCGATGGAGAAAACACAAAACAAAGTGGCAAAAGCTCAGAGGAAGGCGGAGGAGAGGAGAGCC
ACGGCGGAAGGTAAACGAGGGACGGAGGTTGCGAGGGTTCTTGAAGTTGCTAATCTCATGAGAGCC
GTTGGACGACCTCCGGCCAAACGATCATTCTTCTCTCTTTCCTAG

SEQ ID NO: 257 - Arabidopsis thaliana - protein
MTTTTELTRPQQRGSGGGYLSPSRSIAFSDGTTSSGENFTTVSREFNALVIAGSSMDNNSNGTNQS
GGHRDVIRDERNELTRIGENDDVGDHGQVPEEDSNPWAIVPDDYNNRDGSENNIVLASSGGQNRMV
TTASVQRVKREEVEAKITAWQTAKVAKINNRFKRQDAVINGWLNEQVHRANSWMKKIERKLEDRRA
KAMEKTQNKVAKAQRKAEERRATAEGKRGTEVARVLEVANLMRAVGRPPAKRSFFSLS

SEQ ID NO: 258 - Arabidopsis thaliana - DNA
ATGAGATCTAGTGTAGAAGATAACAAAGGATGGATAGGACCAGCGACACCGGAGATATCGAACGGT
TTTGAGTTTCAGAAAGGTTCGAACCGGACACCAAACCATCACCGGTCTACTATGGGGAAGCCAGCG
CCGTCAAAATGGGACGATGCTCAGAAATGGCTTTCTGGTGTAGGGTTTGCTCGTGGAGGTGGTGGA
GGTGGTGACAAGAGTAGTCATCACTCAAGAAGTAATAAGCCGAGAAACTCGAACGCGGATGATCTT
AGACTTATAGCTTCAGCTTCACAGAGAGAACGTGAAGGAGAAGATCAGTACGTTGAGTATGATGAT
GAAGAGATGGCGGCGGGAAGACCGGAGGTTGAGACGAAGAATGTTGATTGTGGTAATCTGTTTGG
AGGAAAGAAAGTAGTATTAATCCAACGGCTGTGATTAGATCCGTTTGTGTGAGAGATATGGGGACT
GAGATGACTCCTATTGGTAGTCAAGAGCCTTCTAGAACAGCTACACCGGTGCAGCTACTACACCG
GTTGGGAGGAGTCCTGTGACTTCACCGGTGAGGGCTTCACAACGTGGTGAGGCGGTGGGGTTGTG
ATGGAGACGGTGACGGAGGTTAGGAGGGTAGAGAGTAATAATAGTGAGAAGGTTAATGGTTTTGTG
GAGAGTAAGAAGGCTATGAGTGCTATGGAAGCTCGAGCCATGGCTTGGGATGAAGCAGAACGTGCT
AAATTCATGGCTAGGTATAAGAGAGAGGAAGTGAAGATACAAGCTTGGGAGAATCACGAGAAGAGA

FIGURE 22 (continued)

```
AAGGCTGAGATGGAGATGAAGAAAATGGAGGTGAAGGCGGAGAGGATGAAAGCAAGGGCAGAGGAG
AAGTTGGCCAACAAGCTAGCTGCGACGAAAAGGATAGCGGAAGAGAGGAGGGCGAATGCGGAGGCT
AAGTTAAACGAAAAGGCGGTGAAGACATCGGAGAAAGCTGATTATATAAGGAGGAGTGGTCACTTG
CCTTCTTCTTTTTCTTTCTCCTTTAAGCTTCCCTCTCGTTGTTGGTGTCAATAA
```

SEQ ID NO: 259 - Arabidopsis thaliana - protein
```
MRSSVEDNKGWIGPATPEISNGFEFQKGSNRTPNHHRSTMGKPAPSKWDDAQKWLSGVGFARGGGG
GGDKSSHHSRSNKPRNSNADDLRLIASASQREREGEDQYVEYDDEEMAAGRPEVETKNVDCGESVW
RKESSINPTAVIRSVCVRDMGTEMTPIGSQEPSRTATPVRATTPVGRSPVTSPVRASQRGEAVGVV
METVTEVRRVESNNSEKVNGFVESKKAMSAMEARAMAWDEAERAKFMARYKREEVKIQAWENHEKR
KAEMEMKKMEVKAERMKARAEEKLANKLAATKRIAEERRANAEAKLNEKAVKTSEKADYIRRSGHL
PSSFSFSFKLPSRCWCQ
```

SEQ ID NO: 260 - Arabidopsis thaliana - DNA
```
ATGCTGACTCTTTACCATCAAGAAAGGTCACCGGACGCCACAAGTAATGATCGCGATGAGACGCCA
GAGACTGTGGTTAGAGAAGTCCACGCGCTAACTCCAGCGCCGGAGGATAATTCCCGGACGATGACG
GCGACGCTACCTCCACCGCCTGCTTTCCGAGGCTATTTTTCTCCTCCAAGGTCAGCGACGACGATG
AGCGAAGGAGAGAACTTCACAACTATAAGCAGAGAGTTCAACGCTCTAGTCATCGCCGGATCCTCC
ATGGAGAACAACGAACTAATGACTCGTGACGTCACGCAGCGTGAAGATGAGAGACAAGACGAGTTG
ATGAGAATCCACGAGGACACGGATCATGAAGAGGAAACGAATCCTTTAGCAATCGTGCCGGATCAG
TATCCTGGTTCGGGTTTGGATCCTGGAAGTGATAATGGGCCGGGTCAGAGTCGGGTTGGGTCGACG
GTGCAAAGAGTTAAGAGGGAAGAGGTGGAAGCAAGATAACGGCGTGGCAGACGGCAAAACTGGCT
AAGATTAATAACAGGTTTAAGAGGGAAGACGCCGTTATTAACGGTTGGTTTAATGAACAAGTTAAC
AAGGCCAACTCTTGGATGAAGAAAATTGAGAGGAAGCTAGAGGAGAGAAAAGCAAAAGCGATGGAG
AAAACGCAAAACAATGTGGCGAAAGCGCAGAGGAAAGCGGAGGAGAGAAGAGCGACGGCAGAGGCA
AAGAGAGGGACAGAGGTTGCAAAAGTAGTTGAAGTTGCTAATCTCATGAGAGCCCTTGGACGTCCT
CCTGCCAAACGCTCCTTCTTCTCTTTCTCCTAA
```

SEQ ID NO: 261 - Arabidopsis thaliana - protein
```
MLTLYHQERSPDATSNDRDETPETVVREVHALTPAPEDNSRTMTATLPPPPAFRGYFSPPRSATTM
SEGENFTTISREFNALVIAGSSMENNELMTRDVTQREDERQDELMRIHEDTDHEEETNPLAIVPDQ
YPGSGLDPGSDNGPGQSRVGSTVQRVKREEVEAKITAWQTAKLAKINNRFKREDAVINGWFNEQVN
KANSWMKKIERKLEERKAKAMEKTQNNVAKAQRKAEERRATAEAKRGTEVAKVVEVANLMRALGRP
PAKRSFFSFS
```

SEQ ID NO: 262 - Arabidopsis thaliana - DNA
```
ATGGATACCTTAATCAAGCAGACAAGGAGGAAGCATCCAGCTTCCCAGGAAAAAATTAGAGAGGTT
GGTAGCTCAACTAGAGAGAAAAAGTGTCAGCAAGGAAGTCTGTTTCATTCAAAGAAGATAAGAAG
AAGCCTTCAAACTGGTTACAGAAGCAGTTCTCGAGGCAAATGAGTGGCCAAAGTTATGATCCCATC
GGAGAAATGGATCATGCAGCTGCAGTTGCAGCCACTGCCTATGCCATAGCCACTTTTGAAGAAACT
TGGCTAGAGAACTATCATGTAACGGTTTTAAAAACAGAGTTTTTGTTAGAAGTGGCCTTGAACTT
GGACCTTCTTCGTCAAGGAGCAAGAGCAGAAGTGAAGAACTGTTGCCTTTAGAGGAACCAAGAAGC
TTATCAAGAAGATTCTCAGGGCAACTTTCGTTTATAGATTCAGAGACGAAAGATCATAAACCTCCT
ACACTAAAGTCCCCAATGAGAAAGTCATCTTCGGTAAAAAGACTTTCTCCATGAACTTGATGGGA
GACCACACCAAACAGAATCAAGATTCAGAGGAGAAACATGAAAGACAAAGAAACCGGTTTCTGAA
CCACCACGGATACAACCACCGCTTAGGACACGATCAGAACCTCGTGCTCCACCGCCACCTCCTCCT
CCTCTTCTATCACCTTCGCCTCTGCGGCTTCCACCTAGGGAAACCAAAAGGCAGAGTTCTGAGCAT
ACTAGTCGAAAGGATGATTCTACAGCTGATGCTTGGGAAAAAGCTGAACTATCTAAGATCAAAGCA
```

FIGURE 22 (continued)

```
AGGTATGAGAAGTTAAACAGAAAGATAGATTTGTGGGAAGCGAAGAAAAGGGAAAAAGCTCGAAGG
AAGCTGGACATATCTGAGCAGAGCGAACTAGAACAGAGGAGAAAGAGAGGTTTGCAGAGATTTAGA
GAAGACACAGAATACATTGAACAGATTGCTGCTGGAGCCAGAGCTCAGGCGGAGAAAGACAGACAG
AGCAAAGAGTTCAAGGTGAAGGAGAAGGCCGGTGTTATCCGTAGTACCGGTAAACTCCCTGGAAAT
GCATGCTGTTTCTGA
```

SEQ ID NO: 263 - Arabidopsis thaliana - protein
```
MDTLIKQTRRKHPASQEKIREVGSSTREKKVSARKSVSFKEDKKKPSNWLQKQFSRQMSGQSYDPI
GEMDHAAAVAATAYAIATFEETWLENYHVTVFKNRVFVRSGLELGPSSSRSKSRSEELLPLEEPRS
LSRRFSGQLSFIDSETKDHKPPTLKSPMRKSSSVKKTFSMNLMGDHTKQNQDSEEKHERQRKPVSE
PPRIQPPLRTRSEPRAPPPPPPPLLSPSPLRLPPRETKRQSSEHTSRKDDSTADAWEKAELSKIKA
RYEKLNRKIDLWEAKKREKARRKLDISEQSELEQRRKRGLQRFREDTEYIEQIAAGARAQAEKDRQ
SKEFKVKEKAGVIRSTGKLPGNACCF
```

SEQ ID NO: 264 - Oryza sativa - DNA
```
ATGGAGACCCAGGAGGCGAAGAGAGCAGATGTGGCGGCGGCGCCGGCGACGGCGACCGGCGGTGAG
GCCGTCAAACCGGCCGCCGGCGATGCTGGCGCAGTAACCAAGACGAATGGACCTTCAGCACCAGCA
GGCAAAGCTGCAACTCCAACGGGTTCGGTTGACAGAGACGCCATACTCGCAAACGTGGAGCTGGAG
AGGAAACTGTCAATGATCAAGGCGTGGGAGGAGAGCGAGAAGAGCAAAGCGGAGAACAAGGCTCAG
AAGAAGATGTCATCCATACTCTCATGGGAGAACACGAGGAAGGCAGCTATAGAAGCAAAACTGCGA
ACACAAGAGGAGAAGCTGGAGAGGAAGAAGGCGGAGTACGCGGAGAAGATGAGGAACCAGGTAGCG
GCGATCCACAAGGCGGCGGAGGAGAAGAGGGCGACGGTGGAGGCGACGCGGCACGAGGAGATAATC
AAGTATGAGGAGATGGCCGCCAAGCACAGGTCCAAGGGGACTACACCCACCAAATTCCTCTCTTGT
TTCGGCTCCTAG
```

SEQ ID NO: 265 - Oryza sativa - protein
```
METQEAKRADVAAAPATATGGEAVKPAAGDAGAVTKTNGPSAPAGKAATPTGSVDRDAILANVELE
RKLSMIKAWEESEKSKAENKAQKKMSSILSWENTRKAAIEAKLRTQEEKLERKKAEYAEKMRNQVA
AIHKAAEEKRATVEATRHEEIIKYEEMAAKHRSKGTTPTKFLSCFGS
```

SEQ ID NO: 266 - Oryza sativa - DNA
```
ATGGCCGGGGAGGCATTGAAGGAGGCGGGGGCGACGCCCGCCGCAGCGAACGCGGGGGAGGAGAAG
GCCGTCATCCCGGCGGCTTCGACATCGCCGGTGATCTCCAAGACCGATGATGACACGGAGCCGCCG
GCCGATGACTCCAAGGCTCTCGTCGTCTTCGTCGAGAAGGTTGCTGATAAACCTCATGCTGAGAAG
GCAACAGCAACAGCAACACCAACAAGGACCTCAAATGACAGAGATATTGCCCTTGCAAAGGTGGAG
ACAGACAAGCGAGAATCGTTGATCAAAGCATGGGAGGAGAACGAAAAGGCAAAAGCGGAGAACAGG
GCCTCTAAGAAGTTATTGGATATTATTTCATGGGAGAACACAAAGAAGGCAGTAATAAAAACTCAA
CTGAAAAAGAAGGAAGAAGAGTTGGAAAGGAAGAAGGCAGAGTACGCTGAGAAGGCGAAGAACAAG
GAAGCAATCGTCCATAAGGAAGCTGAAGAAAAGAGAGCAATGGTGATGGCCCGGCGCGGTGAAGAA
GTGATCAAGGCCGAGGAGATAGCAGCTAAGTACCGTGCAACCGGAGTGACACCGAAGAAACATATC
GGGTGTTTTGGGGCATAA
```

SEQ ID NO: 267 - Oryza sativa - protein
```
MAGEALKEAGATPAAANAGEEKAVIPAASTSPVISKTDDDTEPPADDSKALVVFVEKVADKPHAEK
ATATATPTRTSNDRDIALAKVETDKRESLIKAWEENEKAKAENRASKKLLDIISWENTKKAVIKTQ
LKKKEEELERKKAEYAEKAKNKEAIVHKEAEEKRAMVMARRGEEVIKAEEIAAKYRATGVTPKKHI
GCFGA
```

SEQ ID NO: 268 - Oryza sativa - DNA
ACATCATCCCTCCGCGCAAAAGCCTATCAACAGCTAAGCCAAACAGGGTCAGGAGCCGGAGCCGTC
CGGGAGAGGGAACACTCGAGCGATCCGTCCGTCCGCCCGCCCGTCGTCGTCGCGCGCCATGGCTGA
GGAGGAGGCCAAGAAGGTGGAGGTGGAGGTCACCGAGGCGCCACCCGCCGCTGCCGCTGCCGCGGA
GACGGAGCCGGCTGCCAAGGACGTCGCCGAGGAGAAGGCCGTCATCCCCGCCCCCGCGCCGCCGGC
CGAGGAGGAGAAGCCTCCCGTCGACGACTCCAAGGCGCTGGCCATCGTCGAGAAGGTTGCAGATGA
ACCTCCTGCCGAGAAACCTGCTCAAGGGGGCTCTAATGACAGAGATGTTGCTCTTGCAAGGGTGGA
AACTGAGAAGAGGAACTCATTGATCAAAGCATGGGAGGAAAATGAAGACAAAAGCTGAGAACAA
GGCTTCGAAGAAGCTATCTGCTATTCTTTCCTGGGAGAACACAAAGAAAGCAAACATAGAAGCTCA
ACTGAAGAAGATTGAGGAGCAACTGGAAAAGAAGAAGGCTGAATATGCAGAGAAGATGAAGAACAA
AGTCGCGATCGTCCACAAGGAAGCTGAGGAGAAGAGAGCAATGGTCGAGGCAAAGCGCGGCGAGGA
AGTCCTAAAGGCCGAGGAGATGGCAGCCAAGTACCGTGCCACCGGCCATGCTCCCAAGAAACTCAT
CGGGTGCTTTGGGGCCTAAAGAAATTTTCGATTCACAACGAGCAAACGTGAAAGTGTTCATCAGTG
GTTGCTTTGCTTCTTTCACCCTCCCAAGTGCGTAGTGTGTTTGTTGGTGCAAGAAAGGTCGTGCCT
GGTGTGTAAAGTCTGGTGTTGCTGTATATAACATATTACTCCCAAGACAGATATGTTTGGTGCTGT
ACATGTTTGATGCTTGACAGGCAACATTCTTATGTGTAGTTAAGAAGCCACATTGTTATTGTTATT
GACAGTAAGCTGTTTGTTCTTTT

SEQ ID NO: 269 - Oryza sativa - protein
MAEEEAKKVEVEVTEAPPAAAAAAETEPAAKDVAEEKAVIPAPAPPAEEEKPPVDDSKALAIVEKV
ADEPPAEKPAQGGSNDRDVALARVETEKRNSLIKAWEENEKTKAENKASKKLSAILSWENTKKANI
EAQLKKIEEQLEKKKAEYAEKMKNKVAIVHKEAEEKRAMVEAKRGEEVLKAEEMAAKYRATGHAPK
KLIGCFGA

SEQ ID NO: 270 - Oryza sativa - DNA
AGTTCGTGTGCTTCTCTCATTTGTTCCTTGATATATTTGCTACGTCGTCAGAGAACTCGTGCAGAT
AGCTTCTTTGGCTGAGTTGTTGGAGATGGCGGAGGTGGCGCCGCCGGCGCCGGCGCCGGAGCCGAC
CAAGGACATCGCCGAGGAGAGGGCCGCCGTGCCGGCGCCGGAGGAGTCGAAGGCCATGACCGTCGT
CGATGATGCTGAGAAAGCTGCAGCAACAGGTGGCTCACACGAAAGAGACGCTCTCCTGACGACGGT
CGCCACGGAGAAGAGGATATCGCTGATCAAGGCGTGGGAGGAGAACGAAAAGGCCAAGGCCGACAA
CAAGGCGGCCAAGAAGTTGGCCGACATCGCCTCATGGGAGAACTCCAAGGTGGCCGAGATCGAGGC
CGAGATTAAGAAGTACCAAGTAAGTTCAGCTCAGCTAAGTTCATCAACAAGCAGAACAAGGAGAGA
TCAATTATGTGTGTGTGAATCATTGAGTTGATCGATCGGTTCATATATATGCAGGAGTACCTGGAG
AGGAAGAAGGCGGAGCAGGTGGAGAAGTTGATGAACGGCGTGGCGAAGGTGCACAGGGCGGCGGAG
GAGAAGCGAGCGGCGACGGAGGCGCGGCGAGGGGAGGAGGTGGTGAAGGCCGAGGAGGCCGCAGCA
AAGTACCGCGCCAAGGGAGAGCCGCCCAAGAAGTTGCTCTTCGGTTGAATCTCTTCTCGGTCATCT
CCATTGATCGTCGTCGTCGTCGTTGTTGTAAATGTGTGTGCGACAGTGTGAGTGTACCGGTGT
CAAGTTCAGATAGCTAGTGGTTGGATGTATTTTCTCAGTTGTTTGTTTTCGTTTAATTTCATGTAC
AGGGCAGCTATTGCAGTCTCATGTGAAAAGGGAACATTTATTATGTACAGACATGATGTTTGGG
GTCTTTATTCGGATTCGGCGGTGAAATTGTAACATTTTTGTGCCTGTGGTACTTGGCTAGTACTCA
TGTATAAGAGGCTTACCCATTTGACATTATT

SEQ ID NO: 271 - Oryza sativa - protein
YICYVVRELVQIASLAELLEMAEVAPPAPAPEPTKDIAEERAAVPAPEESKAMTVVDDAEKAAATG
GSHERDALLTTVATEKRISLIKAWEENEKAKADNKAAKKLADIASWENSKVAEIEAEIKKYQVSSA
QLSSSTSRTRRDQLCVCESLS FIGURE 22 (continued)

SEQ ID NO: 272 - Oryza sativa - DNA
GCTTCCACTCTTCTCCTCCACCTCCAAGAACCCCGCATCCATCCATGGCCACCACCGCCCTCTGAT
CCGATCGATACTGATCAGCCAGTAGCTATGCTGGGTTCGGACCAGCTCGAGCACCGCCCGGCGCCG
TCGGCTCCCCGCGCCGAGCCGGACGATGTCGCCGACGACGTGGAGGTGGAGGCGTTCCGGGACATC
CACCCGGAGCCGTCGCCTCCGCATCTACCGCCGCCGCCGCTCAGGCAGCCGTCGTGGGACGCCGCG
AGCCACCGCTCGCTGTCGTCCTCCGGCGCGGGCGGCGGCGGCGACGTCGAGCTGTTCGCCACCATG
AGCCGCGAGTTCACCGCCATGGTGGCGGCCGGGTCGTCGTCCGCGCCCAGCCCCGACGTTCCCGGC
GACGCCCCCGCCGCCGCCGACCTGAACCTGCTGCAGCTGGCGCGCATCGGCGAGAACGAGCCGGCG
GCCGAGGCGAACGCGCTCGCCATCGTGCCGGCGGCGGCGGGCAGCGGCCCGCCGGCGCCGGTGGAG
CAGGTGAAGAAGGAGGAGGTGGAGGCGAAGGTGGCGGCGTGGCAGGCGGAGGAGGTGGCCAAGATC
AACAACAAGTTCAAGCGCGAGGAGGTCGTCATCAATGGCTGGGAGAGCCAGCAAGTCGACAAGGCC
ACCGCCTGGCTCGCCAAGATCGAGAGGAAGCTGGAGGAGGAGCGGGCGAAGGCGACGGAGAAGGCT
CGCAACGAGGCGGCGGCGGCGCGGCGGAAGGCGGAGGAGCGGCGGGCGTCGGCGGAGGCGCGGCGC
GGGAGGAAGACGGCAGAGGTGCTCGACCGTGCCAACTTCTGCAAGGCCGCCGGCAGGGTGCCATCC
AAGCGCTCCTTCTTCTCCTTCTAAAGTTCTAACCAAAGCTAGCTAGCCTTGCTCAATTATATCATC
TCTAGCTAGCTAATTATGATTATTACTTGTTTTCTACTTAATTGATCAATCAATTTC

SEQ ID NO: 273 - Oryza sativa - protein
MLGSDQLEHRPAPSAPRAEPDDVADDVEVEAFRDIHPEPSPPHLPPPPLRQPSWDAASHRSLSSSG
AGGGGDVELFATMSREFTAMVAAGSSSAPSPDVPGDAPAAADLNLLQLARIGENEPAAEANALAIV
PAAAGSGPPAPVEQVKKEEVEAKVAAWQAEEVAKINNKFKREEVVINGWESQQVDKATAWLAKIER
KLEEERAKATEKARNEAAAARRKAEERRASAEARRGRKTAEVLDRANFCKAAGRVPSKRSFFSF

SEQ ID NO: 274 - Oryza sativa - DNA
CGTTGTCCATCACAATTGCTAATTAACTAAGACACCCTTCCTTGATTGTGACACTAGCACGACGCA
CTTTCCTCTATATACATATACATATATCCTCCTTCTGTCCAGCTAACGGTTTATATGCTTAGCTAG
CTGTTTGTTTTGGCGATACCATTTGCATTGCTTGCCCAGCATCGTCGTCGTCGTCGGGAGCAA
GGAGGAGGAGAGACCATCGATCTTGATTGATTTGAAGCTAGATGGCGGAGGAGGCGAAGAAGGTGG
AGGTGACCAAGGACATCGCCGAAGAGAAGGCAGTGGTGCCGCTGCCGACGCCGCCGGCCACCGAGC
ACGACGACTCCAAGGCCATCGTCCTCGTCAAGGAAGCTGAGGCTACAGGAGGTTCAGCTGAAAGAG
ATGCTTATCTCGCAAAAATTGTGTCGGAGAAGAGATTGGTACTGATCAATGCCTGGGAGGAAAGCG
AGAAAGCTAGAGCAGAGAACAGGGCGGCCAAGAAGCTGTCATACATCACTTCATGGGAGAATGCAA
AGAAAGCAGAGATGGAGGCTGAGCTGAAAAGGATCGAGCAAGAACTGGAGAAGAAGAAGGCGGCGT
ACGAAGAGAAGCTGAAGAACAAGCTGGCATTGCTGCACAAGACGGCGGAGGAGAAGAGGGCGCTCA
CCACGGCGAAGCGTGGCGAGGAGCTGATCATGGCGGAGGAGATGGCCGCCAAGTACCGTGCAAAGG
GCGAGGCTCCGACGAAGCTGTTCGGGCTCTTGAAAGCCTGAGAGAAATCATGAGGAGTTCATCATA
CATATATGCTGGGATTTGGTGTTGTTGATTAGTCTGTGAACTTACAGAAATTTGTATATGTGCAAT
GCATGGCATCCGTGTTTGCGTCGTGTATGTCGTCTAATTGAAGGGCCATTTGGTTTGTATTTTG
TCAGTTGGGTGGTTTGATTTCTGGTGCGTTTTGTAAAGGAATTGTGTATATGCATAGGGGAGTGCA
GGCAGGGGATGATGGATTATGAATACGCTTATTCTTTCATG

SEQ ID NO: 275 - Oryza sativa - protein
MAEEAKKVEVTKDIAEEKAVVPLPTPPATEHDDSKAIVLVKEAEATGGSAERDAYLAKIVSEKRLV
LINAWEESEKARAENRAAKKLSYITSWENAKKAEMEAELKRIEQELEKKKAAYEEKLKNKLALLHK
TAEEKRALTTAKRGEELIMAEEMAAKYRAKGEAPTKLFGLLKA

FIGURE 22 (continued)

SEQ ID NO: 276 - Oryza sativa - DNA
ACCACTCACCACCACAGCTCAGCTCGGAGAAGCGAAGAGGAGGAAGAAGAGCAAGACGCCGATGGT
TACGCGTGTGTGCTAGTGGCTGAGCACTAGCGGCGGCGGCGGCGGCGACGGCGACGACGACCTCAC
CCACGGCGGCGACACATGTTGAGTGAACAAACGGCGGCTAGTGGTAGCAGCAGCAGCAGCCGCGGC
GCCGACGACCGGGAGATTGTCATCAGCACCGGCCGGGAGATCGTCGTCAGAAGCAGCGGGGGTGAG
GAGAGGGAGGAGGAGGTGGTGGTGGAGGAGGAGCTCGAGGAGCCGGAGTTCAGGGACATCCACGCG
CTGAGCCCGCCGCCGACGCCGACGCCGAGCCAGCCGTCGTCGTCGTACCACCGGCGGAGGAGGGAG
TCGTGGGAGTCCGCGGCGGGGAGCAGGCACACGTCGATCCGCTCCGTGGGGAGCGACACCGCCCCA
AGTGAGCTCTTCCCTACTATGAGCAGGGAGTTCTCGGCCATGGTCGCCGCAGCAGCCAACGCCAAC
GCCGCCGCCGCCGCAGCCGCGAACGGCGGCGACTCCAGCCGCGCCGGGGTGGACGACGCGCTGGGG
AGGATCGGGGAGGATGAGCTCGAGGAGACGAACCCGCTCGCCATCGTCCCGGACAGCAACCCCATC
CCGTCCCCTCGCCGCGCCCACCTCGCGCTCCCCGCCCCGGCGACGTGTCGTCGGCGGGCGGCGGC
CACGGCGACGAGGTGTCGGTGGGGCAGGTGAAGAAGGAGGAGGTGGAGTCCAAGATCGCCGCGTGG
CAGATCGCCGAGGTCGCCAAGGTCAACAACCGCTTCAAGCGCGAGGAGGTCGTCATCAATGGCTGG
GAGGGCGACCAGGTCGAGAAGGCCAACGCCTGGCTCAAGAAGTACGAGAGGAAGCTGGAGGAGAAG
AGGGCCAAGGCGATGGAGAAGGCGCAGAACGAGGTGGCGAAGGCGCGGCGGAAGGCGGAGGAGAAG
CGGGCGTCGGCGGAGGCGAAGAGGGGCACCAAGGTGGCGCGCGTGCTGGAGCTCGCCAACTTCATG
AGGGCCGTGGGGAGGGCGCCATCCAAGCGCTCCTTCTTCTGAGCGACCGCGCCACCCTCTTCCCCT
CCTCCTCCTCCTCTCTGCTTTGCTCGCCGCCGTCGCCGTCGTCGTCGTCGCCGGCGCCGGCGGCTG
ATCGTTCACCGCTTCGCTTCACACGCAGGGATCAGTGCTGTGATGTGGTTGCTGTGTGGAACTCTC
GTTTTAGTGTTGTATCCACATGTATGATGTACTGTCATCATATCCTCTCTTTTTTTTCTTTTTTTC
TTGTTCTCTTTACTTTCTTGTGCTTGATAAGGGTATTGCAAAGTTGGGAGGGACAGACAGAACAAG
TAAATAGCATAAGTTGGATGGTGCTCTGCCCCTTATAGCTTATGGTGAGGGGACAAGAGCTGCCT
GTAATTTGTTTTTTGTCATCATCAAGGATTGTGTATGTCAATATGAACAAGATATGGAGCTACCTG
TTTTGTGT

SEQ ID NO: 277 - Oryza sativa - protein
MLSEQTAASGSSSSSRGADDREIVISTGREIVVRSSGGEEREEEVVVEEELEEPEFRDIHALSPPP
TPTPSQPSSSYHRRRRESWESAAGSRHTSIRSVGSDTAPSELFPTMSREFSAMVAAAANANAAAAA
AANGGDSSRAGVDDALGRIGEDELEETNPLAIVPDSNPIPSPRRAHLALPAPGDVSSAGGGHGDEV
SVGQVKKEEVESKIAAWQIAEVAKVNNRFKREEVVINGWEGDQVEKANAWLKKYERKLEEKRAKAM
EKAQNEVAKARRKAEEKRASAEAKRGTKVARVLELANFMRAVGRAPSKRSFF

SEQ ID NO: 278 - Oryza sativa - DNA
GCACCACCTCAGCTCGCCAGCAGCAACCACGGCGGCGCTTCGGATGCACGGCGGCGGAGCCTCCAC
GACGACCACCGCCATCGCCGCCGCGCGGGTAGCACATGTTGCATGAGCAGCACGCGCCGCCGCCGC
AGCCGGAGCCGGAGGTTTCGCTACAGCTGTCGGCGCCCGCCACCGCCGCCGACGATGTCGCTGCAG
GCGACGACGAGGAGGTCACCGTCGTCACCACGTACCGCGACATCCACCCTCTGACGCCGCCGTCGC
CGACGACGACGACGACGCCACCCACGCGGCTCGGGTCCGCCGCGTACTCGTGGGACACGGCCAGCA
GCCACCGGTCCGTGTCGTCCGAGGAGCAGTTCATGACGATGAGCCGGAGTTCACGGCCATGGTCG
CCGCCGGGACGACCATGCAGACTGGCCCCAACGACGGCAACAACGGCGGTGACCAGCTCACCAGCA
TCGGCGAGGACGAGCTGGAGGAGACCAACCCGCTGGCAATTGTGCCGGACAGCCACCCGATCGCCA
CGCCGGCCAGGAGCAGGGCGTCCCAGCTGGAGGTTGTCCCCGCGGCAGGGCCATCGCCGGCGCCGC
CGGTGGAGGCGAGGCAGGTGAAGAAGGAGGAGGTGGAGACGAAGGTGTCGGCGTGGCAGACGGCGG
AGGTGGCCAAGATCAACAACCGGTTCAAGAGGGAGGAGGTTGTCATCAACGGGTGGGAGACCGAGC
AGGTCGAGAAAGCATCCGCATGGCTCAAGAAGATCGAGAGAAAGCTGGACGAGCAGCGCGCCAAGG
CGCTGGAGAGGACGCAGAACGACATCGCGAAGGCGCGGCGCAAGGCGGAGGAGAAGAGGGCGTCGG
CGGAGGCGAAGAGAGGCCTCAAGCTCGCCAAGGTGCTCGAGCTCGCCAACTTCATGAAGGCTGTTG

FIGURE 22 (continued)

```
GGAGGGTGCCTACCAAGCGATCCTTCTTCTAGCTTCCTGCAGCCAGCCTCTGCAAACCTTCGATCT
TGATCGATCTGCTGCTGCTCTGTTTCTTTCAGTGCCTTTTGTGTGCTGGATTAATCTAGCTGCCGT
TCTTCGTGTGATGTTTGCTTAGCTGTGCGCATCCGAGAACCTAATTGTAAAAAGATTTTAAAACA
AGTTGTATATTTGCTGTTGCTGCTGTTGCCCTCTGCTGCTTGTGATCACAGAGTGGCCCTTGTTTT
TCCCCTGGCTTGTATTATCCATACGGCATAAATGGTTTGTTTGCTC
```

SEQ ID NO: 279 - Oryza sativa - protein
```
MLHEQHAPPPQPEPEVSLQLSAPATAADDVAAGDDEEVTVVTTYRDIHPLTPPSPTTTTTPPTRLG
SAAYSWDTASSHRSVSSEEQFMTMSREFTAMVAAGTTMQTGPNDGNNGGDQLTSIGEDELEETNPL
AIVPDSHPIATPARSRASQLEVVPAAGPSPAPPVEARQVKKEEVETKVSAWQTAEVAKINNRFKRE
EVVINGWETEQVEKASAWLKKIERKLDEQRAKALERTQNDIAKARRKAEEKRASAEAKRGLKLAKV
LELANFMKAVGRVPTKRSFF
```

SEQ ID NO: 280 - Oryza sativa - DNA
```
ATGGACGGCGACTTGAAGAAGCTAAGGGTTCGATTTCCTGGATTAGGAAAGGGAAACAAGGTGGC
AGACAGGCTCCAACAATACTGCAAGAAGAAGACACATCTCTTCAAAGAGCCAATGTATCTGTAAGG
AGGCCACTTAAACCAGCACAAAGAAAGCAAGAGGACATAGCTTCAGATCAGAAGGTGCCACCCAAG
ATGGTTGATTCTTCTCTGAGCGCGAAGAAAGGTTCGGGTTCCTCTAGCAAATTGCAAGACAAGAAA
GGGAGCAAGAAGTTTGAGCAAGAGCAGGTGATTCAGAAGACCCCATCCACCACAAGGCCAGCAACA
TCGTATCATTCTAGACGGAATGGAGATGGTACTGTTGGATTAACTGCTGTTGGCCCAGCAGACACC
AAAACTAATGAATGGGAGAAGGCGAAGCTCGCTAGCATTACGGAAGAGTATAAGAACATGATGGAT
ACCATAGCTGAATGGGAGAATGAGAAGAAGGTGAAGGCTAAGCGCCAAAAAGAGCAAAAAGAGAAA
GTGTTGGACCAAAAGAGAGCAAAGGCACTAGAAGAATACAGCCAGGAAATAACAAGGATCAACAAA
ATTGCTGGAGGAGCAAGGACAATGGCAGAGGAAAGGAAATATAACGATGAGAAAAAGATCAAAGAA
AAGGCAAATAAAAGACGGTTATCGGAAAAGGCTCCCCGCGCATGCGCTTGCTTTTAA
```

SEQ ID NO: 281 - Oryza sativa - protein
```
MDGDLKKLRVRFPGLGKGNKGGRQAPTILQEEDTSLQRANVSVRRPLKPAQRKQEDIASDQKVPPK
MVDSSLSAKKGSGSSSKLQDKKGSKKFEQEQVIQKTPSTTRPATSYHSRRNGDGTVGLTAVGPADT
KTNEWEKAKLASITEEYKNMMDTIAEWENEKKVKAKRQKEQKEKVLDQKRAKALEEYSQEITRINK
IAGGARTMAEERKYNDEKKIKEKANKRRLSEKAPRACACF
```

SEQ ID NO: 282 - Oryza sativa - DNA
```
GGAGGTGGCAGTAGCAGCTGGCATCCTCCTCCTCTGATCTCCTCCTCGGTCACTTCAGTGCTTACT
TGCCGGTGATGAGGAGGTCTTCTCAGGGGAAGAGCTCCAGCGGCGGCGGCGTTGGCGGCGTACGGA
GGTATGACGTGCACGGTGGTGGTAACTTGCTGGCCTGCTACGCGAAGGCGGCGAGGCCGAGGCCGT
CCAAGTGGGACGACGCGCAGAAGTGGCTCTCCCGGGCGGGCGACGACGACTGCGGCGGCGAAGCTA
CCCGGCGGAGGAGCTCCTGCGCCAGCGCCGACGACGGGCTGCTGCTGCCTCCTCCGCCGGCGGCGC
GGAAGGGGGCCGGCGGCTGGCGATCGTGGAGCAACGTGGAATGGGAGGGCGCGCCCGCGGCGATGG
CGCCGGCGCTGAAGGCCGCGCGCGGCGACGAGGGGGTGGACACCAAGGTGGTGGACGCCGTGCAGG
CGTACGTGCCGCAGCGGTGCGTGGTGTCGCTGAGGGACGTCGGCACGGAGATGACGCCCGGCGGGA
GCAAGGAGCCGTCGAGGGCGAACACTCCCCGCGTCGTCGCGCCGGCGGCGACCGCCCGTGTCGTCG
CGCGGGGCACGGCTTCGCCTGGGCAATGCGACGGCGGGTCGCGTGACAGCGCCGTCGCCGGCGGCG
TGGTGGATCTCCGGGCGGCTCGCAAGCGCGCCGATCAGGGGCACGACGAAGTCGCGGGCACGATCA
CGGCCGTGTCGCCCGCGACGGCGTGGGGCGACGCGGAGCGCGCCAAGTACATGGCCAGGTACAGGC
GCGAGGAGATGAGAATCCAGGCGTGGGAGAACCGGGAGCGGCGGAAGCGGAGCTGCAGATGCGGA
CGGCGGAGGAGAAGGCCGAGCGGATGAGGCTGCGCGCGCAGGCGAGGACGGCGGGGAAGCTGGCGA
CGGCGCAGGCGGAGGCCAAGGCGCGGCGCGCGCGCGCCCGAGGCCGAGCTGGCGCTGGGCCGCCCGG
```

```
GAGGCGGTGCCAAGGGTTGGCTGCTCACGCGGAGCGCGAGCTGGAGCAGCGGCAGCGGCCGCTCGC
CCTCCTCTCTCTCGCTCCGGTTGCCGCTGCTGTGCCGCTGAGAAAAATCCACTGCCACAGTCAAAA
GGCTCGTGATCGATCTGAGAGTTTCCGCTGCTTGTTGAAGGCGGTTTCTGATGTACTACTAGTACC
AGGCACAGAAGAATTTTATCTTTGTACCATCAATGAAGACCCGTTTAGTTTCCC
```

SEQ ID NO: 283 - Oryza sativa - protein
```
MRRSSQGKSSSGGGVGGVRRYDVHGGGNLLACYAKAARPRPSKWDDAQKWLSRAGDDDCGGEATRR
RSSCASADDGLLLPPPPAARKGAGGWRSWSNVEWEGAPAAMAPALKAARGDEGVDTKVVDAVQAYV
PQRCVVSLRDVGTEMTPGGSKEPSRANTPRVVAPAATARVVARGTASPGQCDGGSRDSAVAGGVVD
LRAARKRADQGHDEVAGTITAVSPATAWGDAERAKYMARYRREEMRIQAWENRERRKAELQMRTAE
EKAERMRLRAQARTAGKLATAQAEAKARRARAEAELALGRPGGGAKGWLLTRSASWSSGSGRSPSS
LSLRLPLLCR
```

SEQ ID NO: 284 - Oryza sativa - DNA
```
AACGTTTGCTTCCTCTCTAGAAATCAAGGGGAGGGCACCGCCACCGGAAGAGGGCAAGAAGAACGG
CGAGAAGATGGCGGCCGCCGCCGCGATCCCGATCCCGATCCCCTGCGTCGCGGAGCCCACCGCGGC
GTCCCGCGTCTCGCCGGGCTCGTCCCCGCCCGCTCCGACGCCTCCGAGGGCGCCGCGTTCTACGC
CGCCGACACCGAGGCCGAGCCGGAGGCGTCCGTCGGGAGGAGCACGCAGATGCTGCTCGCGATGGC
CGCCATGGGCGGCCGCGGGGGGCCCTACGGCCGCCGCCCGGCGTCTTCCTACGGCAGCTGCGCCGC
GTGGAGCGCCGGGTCGCTCACCGACCACCGCCCCGCCTCGCCGTCCCCAATCTGCAGCCCCGTGAG
CAGCAATGGAGGGGAGGGCTGCCGCGACGGTGATGACGCCTCCTCGTTCGTCACGCCACGGCTGGA
AGAAGACCAAGAAAGGCTGCCAAACAGAGGAGATTTCATAAATCCGTCTACCACACCACGACACAT
CAGACTGCAAACGCCCAGACAACCTTCCCTTCTGGATAGGAGATTTGAGAGAACTAATCCAGTGCC
ACCAAGATTCATCCACAAGGCCACGCCAGCTAGATTGATGCGCCGAGCTCGCTCCTCACATAATTA
CCGTAGGCGTTTGGGGGCAATGGATGCTATCAATGAATGGAGATTGCCCAAAGTCAGTGAAGAAGA
GGATGAAGCAGTGGATCAAACGGATTGGCAGGCTGATACTCTGTCTTCTCGTATATCCTCAGCTCG
TGATTGGAACTTTGAGGCTGGTGGTGCCTATGAGGGAAGTGATCATAATGGCGGTGCGTTTAACCA
TTCAGATGGCGAAAATAGCCCAGTTGCAGTGCAAAGAATGGGGAGATGGCCCCAGGGTTCTGCGGT
AAAACATAAGGAAAATTTTGTCCACGCCAAGTTGGTTGCCTGGAAGAATGCGGAGATTGAAAAGCT
CATAGACAAGCTGAGAAGGAAAGAGGCCGATATCGATGAATGGCAGATGAATCAGGTTACACAGGC
AAAGGAGAAGATGAAAAGAATTGAGATCAAGTTGGAGAAGAAGAGAGCGAGAGCAGCAGAGAAGAT
GCAAAAGGCAATAAAAGATGCACAAAAGAAAGCTGATAAGAAGAAAATCAAGGAGCATGCAGCAAC
CGACAATCAGATAGCTAGTGTTGAGAGCAATGGTGAAGATGTCTAGGACAGGAAAGCTCCCCTG
GTCACTGGCTTTTCTGTAAACGAGTTCTTCACTTGTGGTAGATCCAAGCAAGCCGATTGTTTTGAA
ACCTCTTGCCGAGATGCCAGCACGGAGAGACTAAAATGAGCGCACATGCTGTCAGTACTCAGAAGC
AGTGCCAACTACTGAAATCAGAAAATTTGTTGTATATAATAGCAGTGGTTTGTCGTCCTTAGATGA
TAGAAGTTTCAGGCTGTATACCTGATTGGCATTTGAACACTGTTCTTAAACATGACACGAACAGTC
AGGGCCAAATTATAGTACTTTCCCTTCTGTTGTGGTTTCAAGTACTGTTCTCAGGCACAACATTAT
TTCCCCAGTAGGATTTGGATGTACATGTACAGTGGCAAACTGACAAGTTTCTTGTTTTGGTATGAT
CTG
```

SEQ ID NO: 285 - Oryza sativa - protein
```
MAAAAAIPIPIPCVAEPTAASRVSPGSSPARSDASEGAAFYAADTEAEPEASVGRSTQMLLAMAAM
GGRGGPYGRRPASSYGSCAAWSAGSLTDHRPASPSPICSPVSSNGGEGCRDGDDASSFVTPRLEED
QERLPNRGDFINPSTTPRHIRLQTPRQPSLLDRRFERTNPVPPRFIHKATPARLMRRARSSHNYRR
RLGAMDAINEWRLPKVSEEEDEAVDQTDWQADTLSSRISSARDWNFEAGGAYEGSDHNGGAFNHSD
GENSPVAVQRMGRWPQGSAVKHKENFVHAKLVAWKNAEIEKLIDKLRRKEADIDEWQMNQVTQAKE
KMKRIEIKLEKKRARAAEKMQKAIKDAQKKADKKKIKEHAATDNQIASVERAMVKMSRTGKLPWSL
AFL
```

FIGURE 22 (continued)

SEQ ID NO: 286 - Oryza sativa - DNA
ACTAACCACACTATAATACGGTACAAATAGATCATATATACACTAGCATAGCACGAAATCGCAAAG
TCCACTAACATCCCACTCCCCCTTCCAAGCTTCTTGTCTCCTCTCCTCTCCCAACTCCCACGCCA
TCTCGCCACCACCAACCGATTCAGGCCGCGCACGCCATTAATGGAGTACGAGCGCATCCACGGCCC
CCCGCTCCAACGTCAGTCGGGTGGATTCTCCCCAGCTAAGCTACGAGCAATGCTTCTCGGACTAGA
GAAAAATCAGCACAACGGGGAGGACACATCGCCTGAGGCCAACGATTCCGGCGAGCTGGACGACCA
GAGGAGCATGGAGTGCTCCACCTCCACCGAAATGTCGAGCAACAGTGGCCACAGATCAAGAAACCG
AGCTCAGGACGACGACAGCTTCGACTCCGAGAGCAGCTCGTCGGGCCCGCCGACGGTGAAGAGGCC
GGCGGCGGTGACCGCCTTGCTGCCACCGTTCTCTAGGCCGACGCCGTCGAAGTGGGATGATGCAGA
GAAGTGGATTTCTAGCCCCACGGCGAACCGCGGTGGCCGTGTGGGGAGTGCAGCTGGGGCTGCGCC
GAAGAAATCGGCGCTGGCATTTCCTGAACATGTAAGCCGGCCTCCAGCCGTTGCTAAGGTGGTTGC
TGAGGTCCCCATCAACACTGGAACCTTGGTGAAGAATTCAGTTGCTCTCGCACAGCCTATTTCATT
TAATCCTGCACAAAGTGCTTCGATAGTTGATGAACCAGCTCCTGCAGTTAGGTCTGTTTCGATGAG
AGACATGGGCACAGAAATGACTCCTATTGCCAGCCAGGAGCCCTCTCGGACTGGGACTCCTATTAT
AGCTTCTAGTCCAACCTCCTCTCGGACACCAACACCACAACGTAATGCAGAAATCAGTATTGGTGA
ATTTGGTCCAAATAAGATGGAAATGTCTGAGGAGGAACTACAAATGAATACAAGAAAGGAAATCAT
GGATCTTGGCCAACGGCTGGGAAAGACAACTATAGCTGCATGGGCTAGCAAGGAAGAGAAATCTAC
AACAAGTTTCGCAAATGTCATAACCGACAAGGCTGTAGAAATCGACAGAGAGGCTCGTGCTGCAGA
TTGGGAGGAGGCAGAGAAAGCAAAATATCTTGCAAGGTTTCAGAGGGAAGAGGTAAAGATTCAAGC
TTGGGAAAACCACCAGAAAGCAAAAATTGAAGCTGAAATGAAGAGGATGGAGGCAAAGATAGAGAT
CAAGAGAGCTCGCGAGCAGGACAGGCTTTCGAGCAAGTTGGCAGCTGCAAGGCACAAGGCAGAGGC
GAGGAGGGAGGCCGCTGAGTCCAGGAAGAACCAAGAAGCAGCAAGAACTGAAGAGCAGGCGGCTCA
GATCCGGAAAACCGGGCACATACCTTCCTAATCTCCTGCTGGTGCTGGTGCCTGTGATTCTTCAC
TCTGCCATGATCATCTGTTATTTGGGTAGAAGAAAAATACTTGCTCCTTGCACGACCATGTAAAAT
ATTCGCTACTGGTTGGTTCATCGTTCAGTGATCAATGCCAATGAGTCGCCATTTTTGTCC

SEQ ID NO: 287 - Oryza sativa - protein
MEYERIHGPPLQRQSGGFSPAKLRAMLLGLEKNQHNGEDTSPEANDSGELDDQRSMECSTSTEMSS
NSGHRSRNRAQDDDSFDSESSSSGPPTVKRPAAVTALLPPFSRPTPSKWDDAEKWISSPTANRGGR
VGSAAGAAPKKSALAFPEHVSRPPAVAKVVAEVPINTGTLVKNSVALAQPISFNPAQSASIVDEPA
PAVRSVSMRDMGTEMTPIASQEPSRTGTPIIASSPTSSRTPTPQRNAEISIGEFGPNKMEMSEEEL
QMNTRKEIMDLGQRLGKTTIAAWASKEEKSTTSFANVITDKAVEIDREARAADWEEAEKAKYLARF
QREEVKIQAWENHQKAKIEAEMKRMEAKIEIKRAREQDRLSSKLAAARHKAEARREAAESRKNQEA
ARTEEQAAQIRKTGHIPSSISCWCWCL

SEQ ID NO: 288 - Oryza sativa - DNA
AGCTTTTAACTGCTCGTCTCATCACTCTCCACCTCTCTCCCTCTCTCTCTCTTCCTCGCGCTCCCA
CGCCACGCAGCAGCCGCAGATCTCCACCCGCCTCCGGCGAGCCCGCCGCCGCCGCCGCCGCCATGG
AGTACGAGCGCATCGAGAAGCCGTTCCCCACCCAGGGCGGTGGGTTCTCGCCGAAGCGGCTGCGCG
CGATGTTGCTGGGGGTGGAGAAGCGGCGGAAGGGGCAGGAGGAGGAGGAGGAGGGGGACGCCGGGG
AGGTGGACGACGAGTACGGCGCGGTGCCCAAGTCCTCTGTCAGATCCGACGCCGACTCCGATGCGC
GCAGAGGAGGTAGCATGTGCGAAGAATACAAGGATGTAGATGTGGTGAGCACCATCTCAGAATCTT
CATCCTCGTTGGAGACAGGGAGTGGGCACCGATCGCGTGACACCCACTCCATGGGTTCACGAGTAA
GGGTGCCTGAGGAGGACTCCTGTGACTCTGAGAGTGTGGCTTCAAACTTTGAGTTCCATAAGGAGC
GAGGGGCCTCTGCTCGGTCTGTGACGGCGGCAATCGTTCCTCCATTCTCAAAGCCTGCACCATCAA
AGTGGGACGATGCCCAGAAATGGATCGCCAGCCCGACAACAAACCGTCCTGGTAGGGCTGGTGGAG
TGCCACAGAGGAAGATGGAAAAAACTAGCTTTGGTGGCGGGAGGCTGCCGGCTACGAAGGTTGTGT
TGGAGGCCACAGAGGAGATAGATACTAAGAGGGTTGATCCAAGCCAAGAGAAAAGGGAAATTGGGT

```
GGCAAAAAGCGGTGAATTGGGCCCCACCTGATCCATATCCAGAAGTTGAGACTTGTGCAAAGTCTG
CACTTGCTGAAGAAATTACAGTAGCTGATTCAGCTGTTACTTTTAGTCGCCATGATTCATCTGCCA
CGCTTCAGAGCGCGACAACATGCATACCTCCCCCACCAACAGTCCGATCAGTGTCAATGAGAGACA
TGGGTACAGAAATGACCCCTATTGCGAGCCAGGAGCCATCCCGAACAGGAACACCGGTGAGAGCAA
CGAGTCCAGATTGTTCTCGCCCAACTACTCCACGAAAAACAATAGGCCCCAATGCAATCGGTGCTG
TTATTGGCCATGGTGAATGTAGCAACGTGGAATTAAGTGAACAAGAATTGCAAATGAAGACTAGGA
GGGAGATAATGCTCCTCGGCACTCAGCTTGGTAAAACCAACATTGCTGCATGGGCAAGCAACAAGG
AAGAGGAAAAAGATGCATCACTTTCGCTTAAAGGAGTGCCCATGGACCAATCTACACAGAAGGTAA
CAGAAATTCGTGCAGCAGCGTGGGAGGAGGCAGAGAAGGCTAAATATTTAGCAAGATTTAAACGAG
AAGAGATTAAGATCCAAGCATGGGAAGATCATCAGAGAGCAAAAATCGAAGCTGAAATGAGAAAAA
TTGAGGTCGACGTGGAAAGGATGCGAGCCCGTGCGCAGGACAAGCTGATGAGCCAGCTCGCATCGG
CGAGACACACTGCCGACGAGAAGCGGGCCGCGGCGGAGCTGAAACGGAGCCGTGCGGCTGCAAAGA
CGGCGGAGCAGGCAGACCACATCAGGAGAACCGGCAGGATGCCGTCCTCCATTGGCTGCTGGAACT
GGTGCTCGTAGTAGCGTAGCTAAGCTCAAGCAACTGAAGCAAGCAAAAGCTCTCCTCACTATGTC
TCGCAAGACTTGAAGCGCCATCATCTGTTTTTACCGTGATCTTGTAGAATATTGTCTTTTGATTGG
TTTCAGTAGATATAAGTCAGAAGAAGACGAGTCACTTGTAAGTAACTATGGAGCAGTATATAAGAT
GCAAGCTTCTTGCCTTTTTCTGTGC
```

SEQ ID NO: 289 - Oryza sativa - protein
```
MEYERIEKPFPTQGGGFSPKRLRAMLLGVEKRRKGQEEEEEGDAGEVDDEYGAVPKSSVRSDADSD
ARRGGSMCEEYKDVDVVSTISESSSSLETGSGHRSRDTHSMGSRVRVPEEDSCDSESVASNFEFHK
ERGASARSVTAAIVPPFSKPAPSKWDDAQKWIASPTTNRPGRAGGVPQRKMEKTSFGGGRLPATKV
VLEATEEIDTKRVDPSQEKREIGWQKAVNWAPPDPYPEVETCAKSALAEEITVADSAVTFSRHDSS
ATLQSATTCIPPPPTVRSVSMRDMGTEMTPIASQEPSRTGTPVRATSPDCSRPTTPRKTIGPNAIG
AVIGHGECSNVELSEQELQMKTRREIMLLGTQLGKTNIAAWASNKEEEKDASLSLKGVPMDQSTQK
VTEIRAAAWEEAEKAKYLARFKREEIKIQAWEDHQRAKIEAEMRKIEVDVERMRARAQDKLMSQLA
SARHTADEKRAAAELKRSRAAAKTAEQADHIRRTGRMPSSIGCWNWCS
```

SEQ ID NO: 290 - Oryza sativa - DNA
```
AGGCATGCAGATGTCTGTACAGTTAATAATGCTGGTGTCACCTCAGAGTATCAAACAAAGGCAACC
GATAACAGTTCATCAATTGAAATAAGGCCCTACAAAGATCCCAAAGCTATTCCTGCAGTTCATTCG
GTGTCCGTGAGAGATGTGGGCACAGAAATGACTCCCATACCGAGTCAGGATCCTTCAAGGACAGGA
ACTCCACTTGGATCAATGACACCAACTCGTAGCCCAAATTGCTCTATACCATCAACTCCTGTAGGA
GGACGGTCAACAGCATCACCAGGAGATGACAACACAGATGATGGACCATATTTCAACAGAAAAGGT
GGCACAAATGAAATATCAGACGATGAAATGAGATTGAAGACAAGGAAAGAAATTGCCGCCCTGGGT
ATACAACTAGGAAAGATGAACATTGCTACATGGGCTAGCAAAGAGGAGCTAGAACTAGTCTCTGCA
TCCCCAAGCATTGCTGATTTGGAGCGGATGAAGAAAGAATATGCAGCTCGTGCAGCAGCATATGAA
GAAGCAGAAAATTTTAAGCATACAGCAAGATTCAAGAAGGAAGAGTTGAAGATTGAAGCATGGGAG
AGCCTTCAAAAAGCAAAATAGAATCTGAAATGAAGAGAATAGAGGAACATGCAGAGAAATTGCGA
AGCGAAGCCATGGCGAAGATGGCTGAAAAGCTAGAAATGACACGGCGTTTAGCTGAAGAGAAACGA
GCCTCAGCCAATGCAAGGATGAACCAACAAGCAGCAAAGGCGGTTCACAAGGCTGAGCTGATTCGC
CAGACAGGACGAGTTCCAGGGTCATGTATCCTATGCTGCAGTGGTTGCTTCTGTCAACACTAGTGT
ATGCTTGACAATTAGGGAGTTAAATATGGTCGTGAAAATCTAAACCCCATGTTCTATAATCAGCA
TTCCTTGGTTTTAGTATGGAAAGGAATGTCTGATACTTTGATTAGGTATTCAGATGTACAAATTCT
TGCTTGTCATAAAAGTCAATCCAATGCTTACATTTGCTTGGTCGGCTACTCGGTTAAAGAACACTT
GGTTGTTGCTCAACGAATTGAATCATTGGAAAATGACGAGCATTTCTTGACT
```

FIGURE 22 (continued)

SEQ ID NO: 291 - Oryza sativa - protein
RHADVCTVNNAGVTSEYQTKATDNSSSIEIRPYKDPKAIPAVHSVSVRDVGTEMTPIPSQDPSRTG
TPLGSMTPTRSPNCSIPSTPVGGRSTASPGDDNTDDGPYFNRKGGTNEISDDEMRLKTRKEIAALG
IQLGKMNIATWASKEELELVSASPSIADLERMKKEYAARAAAYEEAENFKHTARFKKEELKIEAWE
SLQKAKIESEMKRIEEHAEKLRSEAMAKMAEKLEMTRRLAEEKRASANARMNQQAAKAVHKAELIR
QTGRVPGSCILCCSGCFCQH

SEQ ID NO: 292 - Oryza sativa - DNA
AAAGCACAACACTCGCAGCCATTCTGCTTTGCTTTGCTGCTTCTTCCTCCTCCCTCCCTGCTTCTT
TGCTTTCTTGCTAATTTGCAGGTAACTAGAGGTAGTACAGTTTAGCAAGCTCAAAGCTGAGAGAGA
GAGAGGGGTTATAATCTGTCATGGAGTACGAGAGGATACACAAAGTTCAGATGGGAGTGATGTCTC
CAACCAAGCTGAGGATGAAGCTGCTGGGATCCCATGGCGGCAGCATCGGCAGGGTTGACGAGGCAA
AGAAGTCGCCGCGAGCGTCGCCGGCGAGGCTCGACGCCGACGAGGACGACGACGACCACCCCAAGA
ACAGCCTCCTGCCCCAAGAACTCGACGAAGATTATCCCAAGGACCAGTCGGATTCTTCTCGCTCGC
GCTCCGACGCGAGCCATGGGAGAGCTGGCAATGGCTACGACAGCGGCGGCTTCGAGTTCTACAGGG
AGGAGAGGCCGCCGCCACCGCCGCCGGCGGCGGTGGCGGTGGTCGGCGGGACGTTCTTCAGGCAGG
TGCCGTCAAAGTGGAACGACGCCGAGAAGTGGCTCGCCGGGAGACACGTCGTGCACTCCAACCCAA
TCTTCTCCAAGAAGGCCGCCGCCGCAGCAGCGGCCGTGTCCGGCCGCGTTGCGCCGGAGGCCTCGG
CGTCGTCGTCGCCGCCGTCGGTGGCGAGCAGGCAGCGCCAGCAGAAGAGGCTCCGCGTGTCGTCGG
AGGCGGCGGCGGTGTCGATGCGGGACGTGGGGACGGAGATGACGCCGATGGCGAGCAAGGAGCAGT
CGCGGAGCGGCACGCCCGCCGGCGCCGCCACGCCGTCGCTGAGTCCGCTCTGCTCGGTGCCGACGA
GCCCGAGGGGCGCCGCGTCCGCGTCGTCGGCGTCGTCGGAGCGGGAGCTCCAGATCAGGACGCGCC
GCGAGATCGCCGCGCTCGGGCTGCAGCTGGGCAAGATGAACATCGCGTCGTGGGCCAGCAAGGACG
ACGACGACGAGCTCCCCCGCGCCTCGCCGGAGAAGAGACCGAGACCGAGACCGAGACCTCACTCCG
GCGACGGCGGCGGCGAGGCCAAGAAGAGGGAGTTCGAGGCGCGCGCCATGGCGTGGCAGGAGACGC
ACAAGTGCAAGCTCGCGTTGAGGTTTCAGAGGAAGGAGGTGAAGATTCAGGAATGGGAGAGCTGCC
AGAAGGCCAAATTCGAAGCCAAGATGAGGCACGCAGAGGTGCAGGCAGAGCAGATGAAGGCGAGGG
CGAAGCAGAAGCTGAGCAGGAGGCTGTCGGCGTTGAGCCACAAGGCGGAGGGGAAGCAGGCGAGGG
TGGAGGCTCGCCGGAGCCGGCAGGCGGCGCGGCTGGCCCGCCAGGTGCACCGCATCCGGGAGACCG
GCGCCGCGCCGTCGCGCCTCCGCCGCTGCTGCAGCTGGCTGTTCCTCTGAACATCTGAAGAAAAAC

SEQ ID NO: 293 - Oryza sativa - protein
MEYERIHKVQMGVMSPTKLRMKLLGSHGGSIGRVDEAKKSPRASPARLDADEDDDDHPKNSLLPQE
LDEDYPKDQSDSSRSRSDASHGRAGNGYDSGGFEFYREERPPPPPPAAVAVVGGTFFRQVPSKWND
AEKWLAGRHVVHSNPIFSKKAAAAAAAVSGRVAPEASASSSPPSVASRQRQQKRLRVSSEAAAVSM
RDVGTEMTPMASKEQSRSGTPAGAATPSLSPLCSVPTSPRGAASASSSASSERELQIRTRREIAALG
LQLGKMNIASWASKDDDDELPRASPEKRPRPRPRPHSGDGGGEAKKREFEARAMAWQETHKCKLAL
RFQRKEVKIQEWESCQKAKFEAKMRHAEVQAEQMKARAKQKLSRRLSALSHKAEGKQARVEARRSR
QAARLARQVHRIRETGAAPSRLRRCCSWLFL

SEQ ID NO: 294 - Oryza sativa - DNA
AGTTCATTGAACTTCACATAAGCTCACCAAGTAACCAAAACACATAAGCTCAGCTTCAGCTCAGTC
TCCTCCATGGAGCCCAAGTCTTCTTCTTCCTCACACTATCTGCAGCCATCTGCAACATTGCCATCA
ACAAGAAGAAACTCATTCCAAGGAGTGGGAGCTGAAGCTGGAGGAGGAGGAGGAGGCATGAACCCA
TTCGGGCCCACATTCAGTGACCCACTCTGCAGCCTCAACCTCAAGGAGACCTCAGAGTTCGTGAGG
TCATCCTTCCCCATGGCTACCATGGCGAGGAGCAACAGCAGCAACGGCGCCACCGGCAATGGCGGC
CATGGCTACCACCGCGAGACCTCCACGGCCTCTTCATCCTCTTCCTCCTCGGCCTCAGCTCAGAGG
AGGCGAGCCGAGCAGCAGCAGCAGCAGGTGCCAGCTACTCCAGGGCGGCCATTGCTGTTCTTCAAT

```
TCCTCGAGCCCTGCACATCACCAGCTCGTCTCCGCGAGGAGGTCGGTGCCTTCCAAGTGGGAGGAT
GCGGAGAAGTGGGTGAGGCAGGCGTCGTCCGACCACCATGGCGGCCATCACCACCACCATGGCAAG
GGCTCCAAGCTTCAGGAGGAGAAGAGGGCGTCGGCGGTGAGGAGGTCGGTGGATGCTGACGTCACT
GCTCTTGCTCTCTACACTGCTCCTGCTGCAGAAGTGTTCCTCAAAGACAAGTTCACTGACAATGTG
GAGCCCTCCAAGGAGAGCTTCGTGTTCCGGAGCTCCTACTGCGAGCCAACAAAGAACACGGCGGCG
CAGGCGGTGGCCGCCGGCAACGGCATCGACCACCGGCGTGACATCGGCACGGAGATGACTCCGCTG
GGCAGCTCCACCACCTCGAGGTGCCACACGCCGATCAAGAGCACCTCGCCGGCGAGGCACAACACG
CCGGCGAGCCGGTCGGGCCCCCTGGTGCCGTACGCCGGCGGTGGCGGCGGCGCCGGCCAGGACATC
TCGGACCTCGCCGACTGCCACTTCGCCAAGCTGGACCTCGGCGCGCAGTTCGACGCCATGCTCATC
AACTGGAGCTCCAAGGAGGAGGAGGAGGAGGAGGTGTCCAAGAGCTTGAGGCACTTCGAGGCCAGC
GTCGCCGCCGTCGGCGAGAAGCGCGGCGGCGCCGGCGACTGCCGGTGGGAGGACGATGACAGGGCC
AAGAGCTGCATAAGGTATCAGAGGGAAGAGGCAAAGATTCAAGCTTGGATCAACCTGGAGAGTGCC
AAGGCTAAGCACAGTCCAGAAAGCTAGAGGTGAAGATTCAGAAGATGAGATCAAACCTGGAGGAG
AAGCTGATGAGGAGGATGACGACCGTGCACCGGCGCGCCGAGGAGTGGAGAGCGACGGCGCAGGCG
CAGCACCTCCAGCAGCTGAAGCGCGCCGCCGAGCAAGTCCGGCGGGCCAAGGCCACCAGCCACCAT
CACCACCACCACCACCTCGCCGGCAGCAACGCCTCCTGCGGCTGCTTCCCCTGCAATGGCAGCAAC
AACATCATCAGTGGCAACCTCCTGAACTACTATTAGATATGATCAGCTAGCCGCCATGGAAGAAGG
ATCAAGAATGCCAATTTGTTCGGGAGATCAACGGGTTCTTGTTGATTGTAGTGGATGTTTGGGACG
TGTGAAGATGGAGATGTGGGAGATAATGGTGTCATGTGTATCAAAAAACTCTGATTTTTCAAGGTG
ATATATACCAGATTGCTGAATGC
```

SEQ ID NO: 295 - Oryza sativa - protein
```
MEPKSSSSSHYLQPSATLPSTRRNSFQGVGAEAGGGGGMNPFGPTFSDPLCSLNLKETSEFVRSS
FPMATMARSNSSNGATGNGGHGYHRETSTASSSSSSASAQRRRAEQQQQQVPATPGRPLLFFNSS
SPAHHQLVSARRSVPSKWEDAEKWVRQASSDHHGGHHHHHGKGSKLQEEKRASAVRRSVDADVTAL
ALYTAPAAEVFLKDKFTDNVEPSKESFVFRSSYCEPTKNTAAQAVAAGNGIDHRRDIGTEMTPLGS
STTSRCHTPIKSTSPARHNTPASRSGPLVPYAGGGGGAGQDISDLADCHFAKLDLGAQFDAMLINW
SSKEEEEEVSKSLRHFEASVAAVGEKRGGAGDCRWEDDDRAKSCIRYQREEAKIQAWINLESAKA
EAQSRKLEVKIQKMRSNLEEKLMRRMTTVHRRAEEWRATAQAQHLQQLKRAAEQVRRAKATSHHHH
HHHLAGSNASCGCFPCNGSNNIISGNLLNYY
```

SEQ ID NO: 296 - Oryza sativa - DNA
```
TTAACTTACAAGTTAATCTTGAACGTTGAGTGCCACAGGCCCAGGAATAAGATTGAAAGGTCCGAT
TCCTGGTACAGGAACAGGAAGATCAAGGTGGTAACCAGACTATAAGAATGCAACCTCAACAAGGT
AGATTTTTTGGAAGAGAGGAAATGAGCAATGGAGTAGAATACGATGCTGCATATGCAGCCACAGTG
GCTGCGGTAGCGTATGCTATTGCAGCAAAAGAGGAGGAGAAACAGGCAACAGAAGAGACCCGTGTG
AAAAAGAAGTTAACATCTGAAAAGAAGCCTGTCGCGAACGATGAGCCTTCGACCACACCAACTCTC
AAACTACCACCCAACAGACAAGGAATCTTGAAAAGGCCTAGGCAAACCGAGGGGAGCAGAATCACA
AGGCGGTTTAGTGGTAAGGAGATTGTACCCGATGAAGAAGACGACGGACTAGAAGCTAATGTATCG
GTGAGGAGGCCGGTGAGAACGGCACAAAAGATACCAGAAGGTGGAATTTCAGGTCAAAATATGGTA
GGGAAGGTTCTTGATTCTGTCCCAAGCATAAGAAAGGCTCCGAGCTTCGCCAAGCCTTTACCAGAA
AAGAAGGGGAGCATGAAATTTGAGCAAGAGCAGGCAATCCCAACGGTGCCACCGAATGTTAGGCCG
ACAGCTTTATTTCCCCGAGAGAAGAAAGAGAGCAAGAAATTTGATCAAGACCAGGCAATCCCAAGG
GTGCCACCAGATGTTAGGCCAACAGCTTCATTTTCCCGAGAGAAGAAAGAGAGCAAGAAGTTTGAG
CAAGACAAGGCAAATCAAATGCCATCTTTGGCTTCCGCGCCGACGAGTTCATATTCTAGTGAGGCT
GAAGCAATGGCAGATACGTGGGAAGGAAAAGATGGCAAAAATCAAGAAGCAGTACAACATGACA
ATGGATACCATCGTCGAATGGGAGGCCGAGAAGAAGGCCAAGGCCAAACGCCAGATGGAGTTGAAA
GAGGGCGATAATTCAGAGCGGAAGCGAGAGAAGGCGCTGGAGGAGTACAACGACGAGATTACAAGG
```

ATCAACAAGGTGGCCGCAGCATCAAGGCTGACGGCGGAGGAGAAGCGGAGGAGCGCAGAGAGGAAG
GTGAGGGAGAAGGCAGAGAGGATTCGGGTGACGGGAAAGCTTCCCGGCGCATGTGGCTGCTTCTGA
AAACCATCAATGTGTCAATGTGTAGTGGATGTGGCTGTTTCAAATGAAATTTATGTGAAATTGAAC
CAAGCAG

SEQ ID NO: 297 - Oryza sativa - protein
MQPQQGRFFGREEMSNGVEYDAAYAATVAAVAYAIAAKEEEKQATEETRVKKKLTSEKKPVANDEP
STTPTLKLPPNRQGILKRPRQTEGSRITRRFSGKEIVPDEEDDGLEANVSVRRPVRTAQKIPEGGI
SGQNMVGKVLDSVPSIRKAPSFAKPLPEKKGSMKFEQEQAIPTVPPNVRPTALFPREKKESKKFDQ
DQAIPRVPPDVRPTASFSREKKESKKFEQDKANQMPSLASAPTSSYSSEAEAMADTWEKEKMAKIK
KQYNMTMDTIVEWEAEKKAKAKRQMELKEGDNSERKREKALEEYNDEITRINKVAAASRLTAEEKR
RSAERKVREKAERIRVTGKLPGACGCF

SEQ ID NO: 298 - Oryza sativa - DNA
GGCTCGCGTCAGACAGACTCCCTCCTCTCCTCGAGATGCTGTACTTGCCATCGGTCCATCACCCTT
CCATCCCGCCACGTTGCGATCCCCTCGGCCACTTCTATTAAACGCCAACGTACTCCTCATCACGCC
TCCAAACCCGCCGCTTTGATTGTACTTGTGCTTTGCTGTTAAAGAGCTCGCCGGCGTGAGTGGTGG
CGGGTAGAAGTTATATGGAGAGAATGCGGTGTGTTGGTGGTGGTGACACCCCGTTGGGGTTTCGGG
GCGTCGTGGAGGAGGAGCTAGAGGAGGAGGTGGCGGCGGTGTCAGCGTCGGGGAGGCCAATGCAGC
GGCAGCGGCGGCGGCGGCGGCGGTGGGGAGAGGATGCCGACGATGGCTACTCGGCGAGCTCGACTG
GCGGCGGCGGGAGCAGCGGATGCGGCTCCTTCGGCTGTGACTCGCCTTTGGCTGGGTTCGTGCGTG
CTGATGGCGACCCGGACACAGATCTGGAGACAGATGGGGTGGCCACTCCATCCTCCAATGCCTCTG
CAGCATTCGCCGAGCCACACGACGAGGAGGAGGGGACGAGGTGTTGTGTGGGTGGTGGAAGGGG
ACTGGGCACAGCTGCAAGAACCAACCAAGAGTCCGGCAGACCGTACCACCGGAGAATGCCTGTACC
AGCGGCGCCGGTCAGAAGCTGTTCTTTTGCAGGGTAGGAAGGGGTTGAAGCAACGGCCAGCCTCTC
TGGACTTTGGCAGCGGCAGCCCCGGGTTCAATGGAGCCCCTCTTTCTCCGGGCTTTGTGGTTGGGG
GTGTGGGTTTGATGAACAAGGGTCTTGTGTCATCATCATTCATCAGATCAGACGTTTTTCCTAGTC
CCAGGACACCGAACTATCGGCGGCATCGTTCATCAGTATTTGGTTACCAAAAGGGGTGGAGCTCTG
AGAGAGTACCGCTTGCTTCCAAAGGTAACAGGAGGTACCCAGGCAGCAGCATGGCATTTCCCTTCA
GCAATGGGAGGACATTGCCCTCCAAATGGGAGGATGCAGAGAGATGGATCTTCAGTCCGAATTCGA
GTGACGTGCTCGAGAAGACTTCATTTGCTCCTGCTCGGCGACCAAAGTCCAAAAGTGGTCCATTAG
GGCCTCCTGGAAAATTTGGTGGACAATACTCATCTGTGTCATTGCTTGACAATGGGAGAGTTGGAC
ATTTGACAGCAAACTCGCCTTTCTTGGCTGGAGTACTGATACCAGAACATTATTGTGGAGAGAAAG
ATAACATTGGGAGGTATATGAGCAGAACAGCTGGTGAGGAGGCCAGCATTGGCATTGGAGGCAAGT
CTTGTCTGGCAAATGGTGGGTCTCATGCTACTCAATATAACAGAGTTCGTCGACGACTGGATACTG
CGATTGAGTCATCACCTTCATTGCCTAGCACCCAAGCGTCTGTACAAGATGAACAGGTTGGAATCA
CAGAAGAGTCAGCCTCCATTATCACCCCTATAATTTTGCGGAAGGATGCGGCAACTCAAACAAGCC
CAAATCTAAGTCGGTCATCTTCGCCCAGTGTCAGTACTCCATTTATCCATTTGCTTACGACACACC
AAGTCAGAGAAAGGAGAATTGTTTCTCTGATGTTATCAGGGATGTGCACATGGACGATCGAGTGA
CTCTTACCAGGTGGTCCAAGAAACATGTTACACGAGCATCTAGCAAGAACTCAACAAATGTTATAG
ATGTGAAGAAAAGACAGTGGAGTCTAAGTCTTCTTCCTGGGAATTAACAGAAGCAAAATCCATAT
CAAAGGTTGAGCGAGAGCAAGAAAAAATTACTGCTTGGGAACACCTCCAAAAAGCCAAGGCTGAGG
CAGCAATCCAAAAGTTAGTGATGAAATCGAGAAAAGAGATCATCTTCACTGGACAAGATTTGGA
ACACCCTCAGGTCTGCACAAAGAAGAGCACAGGTAATGCGTGAAACTGCAGCAGCAAACCAGGATG
AGCAATCTTCCGGGAAGGCTAAAAGGACATCACACCTTAATAAGAACGGCCAGATCAGCTCTCTGA
GTGGCTGCTTCACTTGCCATGCCTTCTAGTGTCATGTAGTTTAAGAAGGAACAGGACTTAAAGTAA
TTCTTCGTGTTATCAACACGCTCGTGTTGACTTAGTGAAGTTCAGAGATTTACAGAATAAAGATGA
TCCAGCAGATGGAAATTATCCCCCCTTGAATTTTGACAAGATGCTGCTGCAACAATGGGGGACCAT

FIGURE 22 (continued)

```
GCATTATCATGATATAGATTTCTACAGTTCTGCTTTGTGTTAGTTTCGATTCTGCCATGGGGGGAC
AAGAGAAAATGGTGCCACGAAGGAAAGGTGAAATTCTTCTGCATACATCCCATGTGCCTGATTGAT
ATCTTAGCACAATGATAATTGATAAGGTCCTCCTCTATCATTCATTACCCATTACCAACATTCTAG
ATGCTATGAGTTTGTGTGCGATGAAAACAAAGCAGATATGTATCATTTGCACCACAATTCCAACGG
ATAGATAAGAAGGGAATGTTTCAGTCAGAGGGAATACAGTGCCTTACTGTGATTCATGCTGGAAAA
CTCTACTGGATTGTGAAAGGGAACCAGGTGGAATGCAATAGATTTAGCTAGCGTATGCTACATTTG
CATACACAGTTACAATAGCATGTGTTGGAGAAAATATAGGAATACAGGAAAATAGAGATTCTGTT
TGAATTTCATGGCAATTTGACAAGCTCTTCGCAGAACAACTCTCCCATTTCTGTAATGAGCTGTTT
CTTGTAATTCCTATTGCAACACATAGGCGTTACTGAATGTTGATAAATGATATTGCCATCGCAATT
TTTTTTT
```

SEQ ID NO: 299 - Oryza sativa - protein
```
MERMRCVGGGDTPLGFRGVVEEELEEEVAAVSASGRPMQRQRRRRRWGEDADDGYSASSTGGGGS
SGCGSFGCDSPLAGFVRADGDPDTDLETDGVATPSSNASAAFAEPHDEEEGDEVLCGVVEGDWAQL
QEPTKSPADRTTGECLYQRRRSEAVLLQGRKGLKQRPASLDFGSGSPGFNGAPLSPGFVVGGVGLM
NKGLVSSSFIRSDVFPSPRTPNYRRHRSSVFGYQKGWSSERVPLASKGNRRYPGSSMAFPFSNGRT
LPSKWEDAERWIFSPNSSDVLEKTSFAPARRPKSKSGPLGPPGKFGGQYSSVSLLDNGRVGHLTAN
SPFLAGVLIPEHYCGEKDNIGRYMSRTAGEEASIGIGGKSCLANGGSHATQYNRVRRRLDTAIESS
PSLPSTQASVQDEQVGITEESASIITPIILRKDAATQTSPNLSRSSSPSVSTPFIHLLTTHQVREK
ENCFSDVIRDVHMDDRVTLTRWSKKHVTRASSKNSTNVIDVKKKTVESKSSSWELTEAKSISKVER
EQEKITAWEHLQKAKAEAAIQKLVMKIEKKRSSSLDKIWNTLRSAQRRAQVMRETAAANQDEQSSG
KAKRTSHLNKNGQISSLSGCFTCHAF
```

SEQ ID NO: 300 - Oryza sativa - DNA
```
AAAGCTAGTCGCTGACTGACGCTGCCCGCCGTGTGGCCGTGCATTGCTGTCCCTGAGCTTGCTGCT
GCTGGTGGTGGTGACGATTCTGCTCGGTAGAGGAGATGCGAGTTGGGGGTGAGCTCCACAGCGGCG
GCGGAGGAGGAGAGGGGGTGTTGGTGGGGAGGGGATGGAGGAAGGAGGAGGCGGAGGGAGGCGGCG
GCGGCGGCGGCGGCGGCGGGTGCTCGGCGAGCTCGACGAGCCGGGGATCGTCTCTCTGCGACT
CGCCTTTGCCCAGCTTTGTGCGCCATCGTGGTGGACCGGGGTCAGATCTAGAGCTCGATGGGTTGC
CCACTTCCTCCTCCAATGCTTCCTCAGGGTCACACGAGGAGGATCACGGGCCATTGCAAGGGGTGA
AGGGAGAGGGGTGGATGCAAGTGCAGGGACCGATCAAGAACTCAGCTGCCCGTTCTACCGGAGAAT
GCCAAGACCAGCGGTACCGGTTGGGGTCTGTTCTTTTCCATGGTAAGAATGAACGGAAGCAGCGCC
CGGCTTCAGTTGATTTTGGCTGCCCCAGTGTTGACAGATCCTCCACGCATTCTCCGGGTTTCTTGG
TCAATGGTACCGGGGCGATGAACAAGGGATTGAGTGTATCATCGCAAAATAAACCAGGTGCGCCGA
CTAGCCCAGGAACACCAAGCTACAATCGTCAGGGTGCAACAGTTGTTGGGTATCAGCAGGGTTGGA
GCTCTGAAAGAGTTGCCCTGTCTTCAAACGGCCAGAGAAGGCATTCAGGCAACAGCATGGTGTTAC
CACATAATACTGGGAGAACATTGCCCTCAAAATGGGAGGACGCAGAGAGGTGGATCTTCAGTCCGA
ATCCCAGCAATGCACTTGGAAGGACCTCAATCCCGCAGTCGCGGCGACCTAAGGCCAAAAGTGGAC
CTCTTGGACCTCCTGGCAGATTTAGTGAACCATACTCATCAGTTTCGTCATCGTCATATTTGCTTG
ACACCGGGAGAGTAGGAAACCTCACGGCAAACTCACCTTTCCTGGCTGGGGTCTTGCTGCCTGAGC
ATGTTTGTGTGTCCAGTAGCCATGCTGGAAGGGATCTAAGTGGTGCATCTGGTGAGGATAAAAGCA
ATGGCATGGGAGGCAGGTCTGGTGAAGCAAATGGTGCACATCCTGCCGTGTGGTCTACCAGAGTTT
GCCAACGAATGGATAGCGCAGTTCAGTCGTCTCCGTCATTGCCTACTTCCCAAGAATCAGTTCAAG
CTTGCACAGATGAACAGATCGAAATCACAACAGACTTGACCACCAGCAGTAAACCTGAAATTTCGA
GAAAAGATGTGGCAACACAGACTAGCCCTGAGCTTAGCAGGTCATCTTCTCCTAGCGGGAGGCCTT
CATTTTCCCGCTCACTATCAGTACAGCAAGTCAAAGAGTTGGAGAGCTGTTTCTCTAAGCTTGAGA
TAAGGGATGTGCAGATGGATGATCGGGTTACTCTGACCAGGTGGTCCAAGAAACATGTCACACGAG
GCTCTGAGAAGAACTCGACAAACATTATAGAGTGGAAGAAAAAGACAGTGGAATCTAAATCTTCTG
```

FIGURE 22 (continued)

```
CCTGGGAAGTAACAGAAACTGCAAAGTGTATATCAAAGATTGAGGGAGAGGAAGCAAAGATGACTG
CATGGGAGAATCTGCAAAAGGCAAAAGCAGAGGCAGCAATACAAAAGCTTGTGATGAAACTTGAAA
AGAAAAGATCATACTCACTGGAGAGGATTTTCAATACCCTCAGGTCAGCTCATAGGAAAACACATG
TGATACGCAGCACAACTACCACAAATCTTGATCAGCACATCTCCAGGACTGTGAAAAGGCCATCAC
ACCTTAGCAAGAATGGCCAAATGAGTTCGCTGAGTGGGTGCTTCACTTGCCATGCCTTCTAGTATG
GTATTATACAGTCAAGCGGCACTGTCACTTTCAAGATGGAATTGGAGGGGGGAACCAAAAGGCTTG
CTAGTATAGAATACAGATAAGACCTAGCAGGGGAAGCCGAGGCTCTCAATGATATCCAATGGTCTG
TCATTACAAGATTTATTCTAGAATTTCCTTTTTATTCTGCTCAGGAACAAAAGGAAGTTGACGCA
GAGGGAAGGAGTTGTTACTACACACCTTGTGAAGTATTTGTAATAATAAAAATCTCTGCCTATACT
CTTCAGGGCGGAGTGGTATCAT
```

SEQ ID NO: 301 - Oryza sativa - protein
```
MRVGGELHSGGGGGEGVLVGRGWRKEEAEGGGGGGGGGGCSASSTSRGSSLCDSPLPSFVRHRGG
PGSDLELDGLPTSSSNASSGSHEEDHGPLQGVKGEGWMQVQGPIKNSAARSTGECQDQRYRLGSVL
FHGKNERKQRPASVDFGCPSVDRSSTHSPGFLVNGTGAMNKGLSVSSQNKPGAPTSPGTPSYNRQG
ATVVGYQQGWSSERVALSSNGQRRHSGNSMVLPHNTGRTLPSKWEDAERWIFSPNPSNALGRTSIP
QSRRPKAKSGPLGPPGRFSEPYSSVSSSSYLLDTGRVGNLTANSPFLAGVLLPEHVCVSSSHAGRD
LSGASGEDKSNGMGGRSGEANGAHPAVWSTRVCQRMDSAVQSSPSLPTSQESVQACTDEQIEITTD
LTTSSKPEISRKDVATQTSPELSRSSSPSGRPSFSRSLSVQQVKELESCFSKLEIRDVQMDDRVTL
TRWSKKHVTRGSEKNSTNIIEWKKKTVESKSSAWEVTETAKCISKIEGEEAKMTAWENLQKAKAEA
AIQKLVMKLEKKRSYSLERIFNTLRSAHRKTHVIRSTTTTNLDQHISRTVKRPSHLSKNGQMSSLS
GCFTCHAF
```

SEQ ID NO: 302 - Oryza sativa - DNA
```
AGGTGAGGAGGAAGAGGAGGAGGAGGAGTGGAGAGGCGACGGCGACGCGGGCTCGGAGGAGGAGGA
GGGGGAAGCGGTCAGTGACTCCTTCTCCCACTCGCTGAGAGAGTGCCAGAAGCAGCGGAAGCTCAG
AGCGGAGGGGGCTGCGTTGCTGCTTTCACCGGCCAAGCATGAGCTCACCGGCGGAGGTGGTGGGAG
CATAGAACTGCTGGTGCTCTCGCCGAGGTGCTTGGTTGGGGGTAATGTTGGAGGAATGAGCAAGAG
CTCCACAGCGTCATCACGGAGCAGATCAGGCACATTCCCGAGCCCCGGTACCCCAAACTACCACCG
GCATTGCGCTAGCACCATGCAGTACCCTAAGGGATGGAGCTCAGAGCGGGTGCCACTTGGAGGTGG
TACCAATAGGAGGTATGGGGCAGTGGGGTTGTTCTTCCTTTCAACAATGGGAGGAAGCTGCCATC
AAAATGGAGGATGCAGAGAAGTGGATCCTAAGTCCAGTTTCCTGTGATGGGATTGGAAGGATGTC
AGCCCCGGCGCCTCACCATAGACGGCCCAAGTCAAAGAGTGGCCCACTTGGCCACCCAGGCGGAAT
ACCGGGTGCTTATGCGGCTGCTTCGCCGTTTGTGCCCTGCTTTGATGGTGTTCTGGCAGCGGCTAA
TTTTGCAGCACATTCTCCTTTTTCTGCTGGGGTTCTCATGCCAGAGCACGTGCGCAATGGTGACTT
CAGCAGTGGAAGAGGTAGAAGTGGGGATGATGGCAGTAGCCGATCTTACTCTGCAGAGAAGGACCC
ATATATCTTGAGATCAGCAAGTATACATGCGTGGACAGAGACACTTATGGAAGCATCCGCCTTTGC
TAATATCTCAGAAGAAACTGCACAAGATGATAAATTGCAAGGCCTGCGAGGAGAAACTCCTGCCAT
TTCCAGTCCAATAATAAAGAAAGATGTTGCCACACAAATGAGTCCTGATGACAGTATATCGTCTTC
TCCAAAAGCAAGACATTCATGTTCCAGTTTACCATCAGGACATCCTATTAAAGAACCAAATAGTAA
TGCACTTAAACCTGAAGTCCGAGATGTCCAGGTAGATGATCAAGTAACTGTGACCCGGTGGTCCAA
GCGACATGTAACACGAGGGTCTGATAGGCGGTCAACAAATATTGTCGAGTGGAGGAAGAAAACAAT
TGAGACTCGAGCTCCATCTTTTGATGAAAAGAAAGAGAAAGCTGCGTATCAAAGTGCAAGAGGGA
GGAAGCGAAGATCACTGCTTGGGAAAATCTGCAGAAAGCAAAAGCAGAGGCAGCAATTCGAAAGTT
AGAGATGAAGCTTGAAAAGAAGAGGTCATCATCGATGGATAGAATCTTGGGCAAACTACGCACTGC
TCAAAAGAAAGCGCAAGACATGCGTAGTGCAGTTTCTGTGAGTGAAGATCAATGTGGAGTGAGAGC
AACCAAGAAAGCATCATACTTGAGGAGAACGGGCAAATCATTCAGTTGCTGTTTCACCTATCGTGC
TTGCTAGTTGTGACATAGTTGGTACCGTGGGCGTAGCAATGGATGTACCTTTGTAGAAACTTTTTG
```

FIGURE 22 (continued)

```
GACGTTGCAGCTCATGTCAGCCAACAAATCAGAATTAATCAGGAAGTCAGATTTTTCCTTGCTGTG
GCAGCTGGAGGTGACGGGGTTATTTAAAGAGAATTTGCATGGTCTGATCGATGAAATACCTGTAGT
GCCAGTGGAGTGGTATAAATCAGTCATCGAGCAAAATCTATATTGTAGTTAATTTCGTGGATTATT
GCTCCCGTTATTCTGTGCCTACAATCAATCTCTGTACACCCAATAGAAGCTCCTTCGAGTTCGAGA
GCTTTATGCTAGTCACCACCAGATTGGCCAGGTTCAGTGGTTCTCATTCTGATTGATATGTATCTT
TCCATGGGATTCTGTAAGCAAAGCAAGCCTTGGGGCTTG
```

SEQ ID NO: 303 - Oryza sativa - protein
```
MSKSSTASSRSRSGTFPSPGTPNYHRHCASTMQYPKGWSSERVPLGGGTNRRYGGSGVVLPFNNGR
KLPSKWEDAEKWILSPVSCDGIGRMSAPAPHHRRPKSKSGPLGHPGGIPGAYAAASPFVPCFDGVL
AAANFAAHSPFSAGVLMPEHVRNGDFSSGRGRSGDDGSSRSYSAEKDPYILRSASIHAWTETLMEA
SAFANISEETAQDDKLQGLRGETPAISSPIIKKDVATQMSPDDSISSSPKARHSCSSLPSGHPIKE
PNSNALKPEVRDVQVDDQVTVTRWSKRHVTRGSDRRSTNIVEWRKKTIETRAPSFDEKERESCVSK
CKREEAKITAWENLQKAKAEAAIRKLEMKLEKKRSSSMDRILGKLRTAQKKAQDMRSAVSVSEDQC
GVRATKKASYLRRTGKSFSCCFTYRAC
```

SEQ ID NO: 304 - Zea mays - DNA
```
ATGGCCACCACCCTCGCCAGGAGCATCAGCAACAGCAACGGGCACGAACGCCGCCACGAGGCCTCC
ACCACCTCGTCTTCGTCGTCCTCCTCCACGGCCTCGGCTCAGAAACGAAGGGGGGAGTCGCAGCAG
CAGGCCGCCGTCGTCCCGGCGACGCCGGGGCCGGGTCCGGCGCTGCAGTTCCTCGCGAGCCCCGCC
GCGCACCACCACCACCCCCAGACCCAGCTCGTCGCCCGAGGAGGTCGGTGCCGTCCAAGTGGGAG
GACGCGGAGAAGTGGCTGCGGCAGTCGTCGTCGTCCTCGGGTTCCGACCACCACCTCCACGGCAAC
GCGAGGGCCGCCTTCTCCAGGCAGCGGAGCGGCGGGCTCGGACACCGAGGCGGCGCCGGAGGCGGG
GGTGGGGACGAGAAGAGCGCGGCGGTGGCGGTGAGGAGGTCGGTGGACGCGCTCCGGGACGCCCAC
TCGCTCGCGCTGTACGCGGCGCCGGCAGCGGAGGTGCTCCTCAAAGACAAGTTCACCGACAATGAG
GAGCCGTCCAAGGAGAGCTTCGTGTTCCGGAGCTCGTGCTGCGAGGCTGCTGAACCGGCGAAGGGC
GCCGACGACGACGACGACGGTCGCTGCCAGCGGAGGAGGGACGTCGGCACGGAGATGACGCCGCTG
GGCAGCTCGTGCCACACGCCGCTCAAGAGCGCGTCCCGGCGCGGCACAACACGCCGGCGAGCCGG
TCGTCGGGCCCGCTGGTGCCGTACACCGGCGGCGGCGGAACGGACATCTCGGAGCTGGCGGGATTC
CGCCTCGCCAAGCTGGACCTGGGCGCGCGGTTCGGCGCCCACGCCACGCTCGTCGGCTGGAGCTCC
AAGGAGGAGGAGGAGGACGACGACGAGGACGTGTCCAAGAGCCTCAGGCACTTCGAGGCCACCGTC
GGCGGGACAGCCTGCGATAGACGCGGCGGCGGCGACTGCCGTTGGGATGACGACGACAGGGCC
AAGAGCTGCATCAGGTATCAGAGGGAAGAGGCGAAGATCCAGGCCTGGGTTAACCTGGAGAGCGCC
AAGGCTGAAGCGCAGTCAAGAAAGCTGGAGGTGAAGATCCAGAAGATGCGGTGCAACCTAGAGGAG
AAGCTGATGCGGCGGATGACGACGGTGCAGCGGCGCGCGGGGAGTGGCGCGCCACGGCGCGGGCG
CAGCACCTCCAGCAGCTGCGGCGCGCGGCCGCCCACGGCGACGGCGACGGACGGCGGCTCAGGGCC
ACGGCCACGTCCACGGCCCACCACCACCACCGCCACCTGCCGGGCAGCAGCGACGCGCCCTCCTGC
GCCTGCTTCCCCTGCAGCACCAGCACCAGCGGCGGCGGCGGCGTTTTTACTTGAAGCGCGTCGCG
ACAGAGCACGGCCATCTATGCCGCGCAGGCGGGGGGCCCCTGTCGTGGAGCCGTGTGTCCATGTCG
GGGAGCGAGAAGGGGCGGCTGAACCAACGCGAGGTGATGGCCAACCACGCCGTGGATGTTACTGC
AGCCTGCTGCTACTTTCCTCCACTGCCGTGCCGCAGCAGCAGCAGGCAGAGGTTGGATTGGATTGG
ACGGAGAAGAAGAAGTACCATCATGTCTTGCCTTGACCACGTTCCCCGAGTCCCACGTCGACGGC
GGAGGTCGAGGTCGTCGTCGGCCGTCGGGGTCGGGCACGACCTCACCAGGCCTCCTGCTCCTCCA
TGGACTGGGGCCACCAACGGTGATGGGAGTATTACGTGGGCCCGCCCCGCCTCCGAGCGCACCGGC
CGTCTTGGCACGGCCATCCAGGACGGCAAGGCCCTGTACTAG
```

FIGURE 22 (continued)

SEQ ID NO: 305 - Zea mays - protein
MATTLARSISNSNGHERRHEASTTSSSSSSSTASAQKRRGESQQQAAVVPATPGPGPALQFLASPA
AHHHHPQTQLVAPRRSVPSKWEDAEKWLRQSSSSSGSDHHLHGNARAAFSRQRSGGLGHRGGAGGG
GGDEKSAAVAVRRSVDALRDAHSLALYAAPAAEVLLKDKFTDNEEPSKESFVFRSSCCEAAEPAKG
ADDDDDGRCQRRRDVGTEMTPLGSSCHTPLKSASPARHNTPASRSSGPLVPYTGGGGTDISELAGF
RLAKLDLGARFGAHATLVGWSSKEEEEDDDEDVSKSLRHFEATVGGTACDRRGGGGDCRWDDDDRA
KSCIRYQREEAKIQAWVNLESAKAEAQSRKLEVKIQKMRCNLEEKLMRRMTTVQRRAGEWRATARA
QHLQQLRRAAAHGDGDGRRLRATATSTAHHHHRHLPGSSDAPSCACFPCSTSTSGGGGVFYLKRVA
TEHGHLCRAGGGPLSWSRVSMSGSEKGAAEPTRGDGQPRRGCYCSLLLLSSTAVPQQQQAEVGLDW
TEKEEVPSCLALTTFPESHVDGGGRGRRRPSGSGHDLTRPPAPPWTGATNGDGSITWARPASERTG
RLGTAIQDGKALY

SEQ ID NO: 306 - Solanum tuberosum - DNA
TTACCTTCCTCCAACTACTAAATATCTTCTTCTTTGAAGAATTCTCTGTTTTCTTGATTCTGTTTG
TAGCCATGGCAGAATTGGAAGCTAAGAAAGTAGAAATTGTGGACCCTGCACCCCCTGCGCCAGGAC
CTGTTGAAGCTCCTAAAGAAGTGGTGGCTGATGAGAAAGCCATAGTTGCACCAGCTCTGCCTCCTC
CTGCAGAAGAAAAAGAAAAACCCGATGACTCGAAAGCATTAGTTGTCGTTGAAACTAAAGCACCAG
AACCTGCTGATGAGAAAAAGAGGGATCTATTGACAGAGATGCTGTGCTTGCTCGCGTTGCAACAG
AGAAGAGAGTATCACTCATCAAAGCATGGGAGGAAAGTGAGAAATCAAAAGCCGAAAACAAAGCTC
AGAAGAAGGTATCTGCAATTGGTGCATGGGAGAACAGCAAGAAAGCTAACCTAGAGGCTGAGCTCA
AAAAGATGGAGGAACAGTTGGAGAAAAAGAAGGCCGAATATACTGAGAAAATGAAAAACAAAATTG
CTCTACTCCACAAGGAAGCAGAAGAAAAGAGAGCGATGATTGAAGCTAAACGTGGAGAAGATCTTC
TCAAGGCAGAGGAGCTTGCAGCAAAATACCGTGCCACTGGAACTGCTCCAAAGAAAATCCTTGGAA
TATTTTGAAGCAGCAAGCACCAGGTCTGCATCGGTAGTGATTGGGAGTTACATTTTGTAAAGTTTG
TGCAATTGGAATTTTGTTTCTTGTTAGATTACATTTGTGTGATTATGTATTTTAGAACCATTTATT
GTTTATTGTTACGTGTGCATAGTGATGTATTTCCAGTGTATATAGCACCTGGACAAATTAACTTTG
TGGGATTGTATGAAAAAAAATGTTGAAGGAAATCTTCATGTTAGTACACAACTCTTGCAGAAAAAA
AAAAAAAAAAAAAAAAAAAAA

SEQ ID NO: 307 - Solanum tuberosum - protein
MAELEAKKVEIVDPAPPAPGPVEAPKEVVADEKAIVAPALPPPAEEKEKPDDSKALVVVETKAPEP
ADEKKEGSIDRDAVLARVATEKRVSLIKAWEESEKSKAENKAQKKVSAIGAWENSKKANLEAELKK
MEEQLEKKKAEYTEKMKNKIALLHKEAEEKRAMIEAKRGEDLLKAEELAAKYRATGTAPKKILGIF

SEQ ID NO: 308 - Glycine max - DNA
ATGGCGGAGGTAGGGTTTCAGGAACGAAGCTCGTGGAGAGTGGGGCTGAGAGCGCGCTATAGCAGC
CCCGACTCTGTGGTTTTCACTCTCGAATCGAACTTGAGCCTCTTCTCCTATGCGTCCGCGAGCGTT
GATCGATGCTCCTTTTCATCTGATTCACACGACCACGACTCTTTCGTCTCCGAAATCTCACTGGAT
ATGCGGTGGTGGTGGCATAATAATAATAATAATGGAAAAGATTACAAACACGCCACGAGGGCTTTT
AATTTCGGAAAAATTGACGCTGATATTCAAGAACCCGTGGAGTTGGATTCTGCCAGAAACTCTTTC
TCTTTAGCCCTCAAAGAGGCTGCTTCTTTGGATCTGAACAATGCCTCTGGCTCTGGATCTTTGCCG
CGCCTTCAAACATTGAAAAGACTTCCATTTCTTCTCGAAGGTCTGGTACTGCCACTTTCCCTAGT
CCTGGTACACTCAATTATCGCGTTGCAATGCACAAGGGATGGAGCTCCGAGCGAGTTCCCTTGCAT
GCAGGTGCTACCCGGAAGCACGTTTTGCCGTTCAACAATGGGAAACATTGCCGTCAAAGTGGGAA
GATGCTGAGAGGTGGATTCTCAGCCCTGTTTCGGCAGATGGCACTGGGAGGGCCTCGCTTAATGCA
CCCCAAAGGAGGCCAAAGTCCAAGAGCGGTCCTCTTGGACCCCCTGGTGTTGCGTATCATTCTATG
TACTCGCCGGCCGCGCCGGTGTTTGAAGTGGGGAATGGGGGAGTTTTATGGAAGGTTCTCCGTTT
ACAGGTGATGGGTTAATAATCTGCACCGGTGGCCATGGTGGAGCTCTTTCCGTGAGAACAGAACCT

FIGURE 22 (continued)

TGCATGGCACGCTCAGCAAGTGTCCACGGATGCTCTAAGATACAGAGTCAGTCATCATCAATGCCC
CTCCAAGAGGATAAGTTTGGTGGGTTCAAAGATGTGGGCACCAATGTGTCCCGTGCCACTTCAAGG
AGGGACATGGCGACCCAGATGAGCCCACAGGGTAGCTCACGCTCCTCTCCTAATCTGAGGCCTTCT
TTCTCTGCCTCCACCCCATCAACCTTGCCTGTCACAGAATTGCGGACTGTTGGTTCCTCTAAAGTG
GATATTAGGGATGTGCAGGTAGATGAACACGTTACCGTGACAAGATGGTCCAAGAAACATAGGGCC
CTATTCACTGGCAGAGGCTCAGAAAAAGTCGAAAGCTGGAAAAAAGAACTAAGCACTCAATCGTCA
ACTTGGGACGTTTCTGAAACGTCAAAGCCTGCCTCAAAGACAAGAAGTGAGGAAGCCAAATCTCT
GCATGGGAGAACTTGCAAAAGGCAAAAGCAGAAGCAGCAATACGGAAACTAGAGATGAAATTGGAA
AAAAGGCGAGCATCCTCTATGGATAAGATTATGAACAAGCTTAGATTGGCCCAGAAAAAGCTCAG
GAAATGAGAAGTTCAGTTCCACACAACCAAACCGATCGGGTTGTAAGAACTTCACACAAGGCTTCA
TCATTTCTTAGAACCAGCCAGATGCGTTCTTTGAGTGGTTGTTTCACTTGCCATGTCTTTTAA

SEQ ID NO: 309 - Glycine max - protein
MAEVGFQERSSWRVGLRARYSSPDSVVFTLESNLSLFSYASASVDRCSFSSDSHDHDSFVSEISLD
MRWWWHNNNNNGKDYKHATRAFNFGKIDADIQEPVELDSARNSFSLALKEAASLDLNNASGSGSLP
RLQTLKKTSISSRRSGTATFPSPGTLNYRVAMHKGWSSERVPLHAGATRKHVLPFNNGKTLPSKWE
DAERWILSPVSADGTGRASLNAPQRRPKSKSGPLGPPGVAYHSMYSPAAPVFEVGNGGSFMEGSPF
TGDGLIICTGGHGGALSVRTEPCMARSASVHGCSKIQSQSSSMPLQEDKFGGFKDVGTNVSRATSR
RDMATQMSPQGSSRSSPNLRPSFSASTPSTLPVTELRTVGSSKVDIRDVQVDEHVTVTRWSKKHRA
LFTGRGSEKVESWKKELSTQSSTWDVSETSKPASKTRSEEAKISAWENLQKAKAEAAIRKLEMKLE
KRRASSMDKIMNKLRLAQKKAQEMRSSVPHNQTDRVVRTSHKASSFLRTSQMRSLSGCFTCHVF

SEQ ID NO: 310 - Medicago truncatula - DNA
ATGTTGAATAATAATCTAAATACTTCCACCAGCCATATATCAGAGGAAAACCAAGAAGATGAACAA
ATAACAGAAATAAGAGAAATCCATGCCTTAACACCACCTCGTCTTCCACCTCCTCCACCACCAACC
AACCGCGGCAGCCATAGCCACCGTTCATCATCTCTATCCATGGCTAGCACAGATAGTGAAAACTTC
ACAACTATAAGCAGAGAATTCAATGCTCTAGTTCTAGCAGGATCAACTGTTGACCACAACAACATA
AGTCCTCATGAACATGAAACAGCTAACAACAACAATAACAATAACAGCAACAATTTGAGGAGGATT
AGAGAAGATGATCATATGATGGAAGAAACCAATCCTTTGGCGATTGTGGTAGATAACAGCCCTTTT
GATCCTATTCCATCTCCTACTAGCAGAAGAAATATGGCTAGTGGAAGTTCACGTGCAAGTGGTCAA
GGTGGTAGTGAAGAACATGTGTCGGTGGATAGGGTGAAGAAGGAGGAAGTTGATGCAAAGATATCA
GCTTGGCAGAATGCTAAAGTTGCTAAGATTAATAACAGGTTCAAGAGAGATGATGCTGTCATCAAT
GGCTGGGAGAGTGAACAGGTTCAGAAAGCTACTTCATGGATGAAAAAAGTTGAGAGGAAGCTGGAA
GAGAAAAGAGCAAGAGCCTTGGAGAAGACGCAAAACAAAATAGCGAAAGCTCGAAGAAAAGCCGAA
GAGAGGAAAGCATCAGCAGAGGCAAAAAGAGGAACTAAAGTGGCTAGAGTTCTTGAGATTGCTAAT
CTTATGAGAGCAGTTGGAAGACCTCCTGCTAAAAAATCTTTCTTCTAA

SEQ ID NO: 311 - Medicago truncatula - protein
MLNNNLNTSTSHISEENQEDEQITEIREIHALTPPRLPPPPPTNRGSHSHRSSSLSMASTDSENF
TTISREFNALVLAGSTVDHNNISPHEHETANNNNNNSNNLRRIREDDHMMEETNPLAIVVDNSPF
DPIPSPTSRRNMASGSSRASGQGGSEEHVSVDRVKKEEVDAKISAWQNAKVAKINNRFKRDDAVIN
GWESEQVQKATSWMKKVERKLEEKRARALEKTQNKIAKARRKAEERKASAEAKRGTKVARVLEIAN
LMRAVGRPPAKKSFF

SEQ ID NO: 312 - Medicago truncatula - DNA
ATGCGTGATTTAGGGTTTCACGAACAACGACGCTCGTGGAGGCGTAACACCGGTTCAAGAACACGC
AACACCACCGCCAACACCGTCACCGGCGGCGGCGATACAAGTCCTGACTCCGTCATCTTCACTCTC
GAATCTAACTTAAGTCTCTTCTCCTCCGCTTCCGCCAGCGTCGATCGCTGCTCCTTCGCTTCCGAT

FIGURE 22 (continued)

```
GCTCACGACCGCGACTCCTTAAACTCCGAAATCTCACTGCATTTGGCAGGTCACGGTGGTGATTTT
GCTCCCAGTGAAAGCTGGAGTGGTCCAGATCCGGATCCGGATCCGAATCAAAATCATAACAGAAAA
CAACATGCAGATTCAGATTCAGTTCAGAAAAAGAAACTTGGCGAAACTCTTTTCTCTGGAAAAGCA
GAAAAAACAAAAGTTCAAAAGGAAGATAGTGACATTGATTCTAAAGACGGAAATCAACTTTCGGAA
TTTGATTCTGCGAGAAACTCTTTCTCTCTAGCTCTCAAAGAATGTCAAGATCGGAGATCGAGATGT
GAATCTTTATTTAAAAAGCAAGATCGGCGAAGACCTGCTTCGTTAGATCTGAACAATGCTAATGCA
ACTGGAACTGGTTCTTCGCCTCGATTAGTTGGAGCTGTGAAGAAGAGTATGGTTCAGTCTAGGAAA
TCGGGAACGGGTACAGCGACGGGGACTGGTACATTTCCGAGTCCTGGGACTCCGAATTATCGTCAT
TGTCAAGGCGGTGTTGCAATGCAAAAGGTTGGAGTTCTGAGAGAGTTGCAAGTGGGGGCCGCAAG
CAAGTTGGTAATGGTGTGACTGCTTTGTGTTTAAGTAATGGGAGAACGTTGCCGTCGAAGTGGGAA
GATGCTGAGAGGTGGATTTTGAGTCCTGTTTCAGGGGGTGATGGAACTGGAAGGGTTTCAGTTCCA
CAGCCATTAAGGAGGCCGAAGTCGAAGAGTGGTCCGCTTGGTCCACCTGGTGTTGCGTATTATTCG
TTGTATTCGCCTGCAGGTCACTTTTTTGATGGAGGGAATTTTATGACGGCTGCTTCACCTTTTTCT
GCTGCTGTTAATGCTTCAGCTGATGGGTTTACAAATAGTTCTGGTGGCAATGGTGGTGGAGGGCTT
CCCACACGAACGGATCCTTGCATGGCTCGCTCAGTTAGTGTACATGGATGCTCTCAGATGCAGGGT
CAATCGTCGATTCCTTCCCGAGAGGAGAAGTTTGATGCTTTCAAGGATGCGGGCACCAATGTATCT
CCTGCTGTTTCAAGAAGGGACATGGCAACCCAGATGAGCCCAGAGGGTAGCTCGTGCTCCTCTCCC
AATATGATGACTTCTTTCTCTGCTTCCATTCCACCTACCCTGCCCGTAACCGATTTGCAGAGTATC
TCTTTCTCTAAAATGGATATCAGGGATGTGCAGGTGGATGAACGTGTAACCATGACAAGGTGGTCC
AAGAAGCACAAGGCCCTATTCACTGGTAGAGGTTCAGAAAATGTTGACAGCTGGAAAAAGAAAGAA
ACCAGCACTCGATCTTCATCTTGGGAAATTTCTGAACGCTCAAAGACTGTTTCGAAGGCTAAAAGG
GAGGAAGCCAAAATCACCGCATGGGAAAATTTGCAAAAGGCAAAAGCTGAAGCAGCAATACAGAAA
CTAGAGATGAAGTTGGAAAAGAAGCGAGCATCTTCCATGGATAAGATTATGAACAAACTGAAATTC
GCTCAGAAAAAGGCTCAGGAAATGAGGAGTTCAGTTTCAGTCGACCAGGCTCATCAAGTTGCCAGA
ACTTCTCACAAGGTTATGTCATTTCGGAGAGCTGGCCAGATGGGTTCTTTGAGTGGTTGTTTCACC
TGTCATGCCTTTTAA

SEQ ID NO: 313 - Medicago truncatula - protein
MRDLGFHEQRRSWRRNTGSRTRNTTANTVTGGGDTSPDSVIFTLESNLSLFSSASASVDRCSFASD
AHDRDSLNSEISLHLAGHGGDFAPSESWSGPDPDPDPNQNHNRKQHADSDSVQKKKLGETLFSGKA
EKTKVQKEDSDIDSKDGNQLSEFDSARNSFSLALKECQDRRSRCESLFKKQDRRRPASLDLNNANA
TGTGSSPRLVGAVKKSMVQSRKSGTGTATGTGTFPSPGTPNYRHCQGGVAMQKGWSSERVASGGRK
QVGNGVTALCLSNGRTLPSKWEDAERWILSPVSGGDGTGRVSVPQPLRRPKSKSGPLGPPGVAYYS
LYSPAGHFFDGGNFMTAASPFSAAVNASADGFTNSSGGNGGGLPTRTDPCMARSVSVHGCSQMQG
QSSIPSREEKFDAFKDAGTNVSPAVSRRDMATQMSPEGSSCSSPNMMTSFSASIPPTLPVTDLQSI
SFSKMDIRDVQVDERVTMTRWSKKHKALFTGRGSENVDSWKKKETSTRSSSWEISERSKTVSKAKR
EEAKITAWENLQKAKAEAAIQKLEMKLEKKRASSMDKIMNKLKFAQKKAQEMRSSVSVDQAHQVAR
TSHKVMSFRRAGQMGSLSGCFTCHAF SEQ ID NO: 314 - Medicago truncatula - DNA
ATGAACATGTATAGCAAAACAAGGACTATTACAACAACAAAAACAACCCTTTTGTTGATGATTTC
ATTGATCCACTTTGCAAGCTGAACCTAAAAGAAACCTCTGAGTTTGTCAAATCTTTACCAGTTTCA
AACACCAATGCAGAAAACAGAAGACTCAGCAATGATTCTGTAACACAAATGAGAAAACTAGAAGCT
CCTTCTACACCTGGTAGACCACTTTTCAGCTTCAGTTCTTCTTCTTCTTCAAGCATTGTTGGTAGA
AACCTTCCAAGAAAGAGTTTTCCTTCTAAATGGGATGATGCTGAAAAATGGCTTATAAGCACTTCT
TGTCATGACTCACCAGCTCATAATAACAACACTTTGAAAGGTGTTTCATCTTTAGAATCTGGAACA
AGACATTGTGATAATGGTTTTAAGCAGAAAATGGAAGAAGGGTTTTCAGAGAAATCAAGGGTCATA
GAAGAAAAGTGTTGTCAAAAGTGTTACTAATTTTCAAAGTTCTTCTTCAAGTTTGGACCACAAT
```

FIGURE 22 (continued)

```
AACAGTGTTGGAGCTTTCAATGGTATCTCATGTCCACCAACAGACATAGTACTAAAAGATAAGTAC
ACAGACAGCATAGAGCCAATTTTACCAAAATTCCGGTATTCAGAACCAACAAAAGAAGGATTCTTA
TTCAGAAATCAAGCTTGTGAGGCAATGCATGAATCTTACACAGAAGTGATTCATGAAGTTAAACAC
AAAGATGTTGGCACAGAAATGACTCCATTAGGAAGTTCCACAACTTCAAGATGTCACACACCATTC
AAGAGTTCATCGCCTGCGCGCCATAACACTCCTGCTAGTAGGTCAGGACCATTGGCATTATCTAAC
ATTGACAGCAATGGATGCAGTGTTGATGCTATTCAGCTAGAAGAGTGTCATTTTTCTAAACTGCAA
TTTGGAACGACAAAGTATGATTTGGTTGCACCAAATTGGAGCTCAAGTGAAGAGGAGGAAAAGGAA
ATATCGAAAAGTTTGAGACATAATGCTAGTTTGAAAGCCGATTCTGATTGTATAGCTGCCAGTTGG
GAAGAAGATGAGAAGAACAAGTGCTGTCTTAGGTATCAGAGAGAAGAAGCAAAAATCCAAGCATGG
ATAAACCTCCAAAATGCTAAAGCAGAAGCCAGGTCAAAAAAGCTTGAGGTGAAAATCCAAAAGATG
AGATCAAACCTAGAAGAGAAGTTAATGAAGAGGATGTCAGTGGTTCACAGGAAAGCTGAGGATTGG
AGAGAAACAGCTAGACAACAACACTTAGAGCAAATGGAGAAATCAACTCAACATGCTAAAAAGATT
ATTCATAGGCATAACTCACAATTTTCTAGGCACAGTTCATGTGGATGCTTTCCTTGCAATAACAAC
CATTAA
```

SEQ ID NO: 315 - Medicago truncatula - protein
```
MNMYSKNKDYYNNKNNPFVDDFIDPLCKLNLKETSEFVKSLPVSNTNAENRRLSNDSVTQMRKLEA
PSTPGRPLFSFSSSSSSSIVGRNLPRKSFPSKWDDAEKWLISTSCHDSPAHNNNTLKGVSSLESGT
RHCDNGFKQKMEEGFSEKSRVIEEKVLSKSVTNFQSSSSSLDHNNSVGAFNGISCPPTDIVLKDKY
TDSIEPILPKFRYSEPTKEGFLFRNQACEAMHESYTEVIHEVKHKDVGTEMTPLGSSTTSRCHTPF
KSSSPARHNTPASRSGPLALSNIDSNGCSVDAIQLEECHFSKLQFGTTKYDLVAPNWSSSEEEEKE
ISKSLRHNASLKADSDCIAASWEEDEKNKCCLRYQREEAKIQAWINLQNAKAEARSKKLEVKIQKM
RSNLEEKLMKRMSVVHRKAEDWRETARQQHLEQMEKSTQHAKKIIHRHNSQFSRHSSCGCFPCNNN
H
```

SEQ ID NO: 316 - Lycopersicon esculentum - DNA
```
ATGGCAGAATTGGAAGCTAAGAAAGTAGAAATTGTGGACCCTGCCCCTGCACAAGAACCAGTTGAA
GCTCCTAAAGAAGTGGTGGCTGATGAGAAAGCCATAGTTGAACCAGCTCCGCCTCCTCCTGCAGAA
GAAAAAGAAAAACCCGATGACTCGAAAGCACTAGTTGTTGTCGAAAATAAAGCAGAAGAAGCTGCT
GATGAGAAAAAGAGGGATCTATTGATAGAGATGCTGTGCTTGCACGCGTTGCAACTGAGAAGAGG
CTATCACTCATCAAAGCATGGGAAGAAAGTGAGAAATCAAAAGCCGAAAACAAAGCTCAGAAGAAG
GTGTCTGCAATTGGTGCATGGGAGAACAGCAAGAAAGCAAACCTAGAGTCTGAGCTCAAAAAGATG
GAGGAACAGTTGGAGAAAAAGAAGGCAATATATACTGAGAAAATGAAAAACAAAATTGCTCTACTC
CACAAGGAAGCAGAAGAAAAGAGAGCGATGATTGAAGCTAAACGTGGAGAAGATCTTCTCAAGGCA
GAGGAGCTTGCAGCAAAATACCGCGCCACTGGAACTGCTCCAAAGAAAATCCTTGGAATATTTGA
```

SEQ ID NO: 317 - Lycopersicon esculentum - protein
```
MAELEAKKVEIVDPAPAQEPVEAPKEVVADEKAIVEPAPPPPAEEKEKPDDSKALVVVENKAEEAA
DEKKEGSIDRDAVLARVATEKRLSLIKAWEESEKSKAENKAQKKVSAIGAWENSKKANLESELKKM
EEQLEKKKAIYTEKMKNKIALLHKEAEEKRAMIEAKRGEDLLKAEELAAKYRATGTAPKKILGIF
```

SEQ ID NO: 318 - Lycopersicon esculentum - DNA
```
ATGGCAGAAGCTACTGCAGTTGCAGCTCAACCTCAACCAGAATCAACAACTCCTCCTCCCATGGCC
AAATCTGATGACTCTAAAGCTATTGCTACTCTTCCCCCAACAAAGCCTGACTCTTCAACAAAGAAA
AGTTCAAAGGGATCCTTCGACAGAGATGTTGCTCTCGCACACCTTGAAGAAGAGAAAAGGAATTCC
TATATCAAGGCATGGGAAGAAAGTGAAAAAGCAAGGTGAATAACAAGGCCGAGAAGAAGCTCTCG
TCAGTTGGAACATGGGAGAACACCAAGAAAGCAAATATTGAAGCTAAACTGAAGAAACTTGAGGAA
CAACTAGAGCAAAAGAAGGCAGAATATGCAGAGAAGATTAAAAATAAAGTAGCTGCAGTTCACATG
GAGGCAGAGGAAAAGAGAGCTATGGTTGAAGCGAGACGAGGAGAAGAACTTCTTAAAGCAGAGGAG
ATAGCTGCCAAGTATCGTGCTACGGGACAAGCCCCTAAGAAGATTGGATGCCTTGGATGTTAA
```

SEQ ID NO: 319 - Lycopersicon esculentum - protein
MAEATAVAAQPQPESTTPPPMAKSDDSKAIATLPPTKPDSSTKKSSKGSFDRDVALAHLEEEKRNS
YIKAWEESEKSKVNNKAEKKLSSVGTWENTKKANIEAKLKKLEEQLEQKKAEYAEKIKNKVAAVHM
EAEEKRAMVEARRGEELLKAEEIAAKYRATGQAPKKIGCLGC

SEQ ID NO: 320 - Medicago truncatula - DNA
ATGGCAGAGACACAAGTAAAATCAGAATCATCATCTGATATTGTTCTAGCAGAAGTGACCAAAGAG
AAAAAGCTATGTTATGTGAAAGCATGGGAAGAAAGTGAAAAAACCAAAGCAGATAACAAAGCTCAC
AAGCACATCTCTTCCATTGCTGCTTGGGAAGACAGCAAAAAGGCAGCTCTAGAAGCTGAGCTCAAA
AAAATTGAGGAACAACTAGAGAGAAAGAAAGCAAGATATGGTGAAATAATGAGAAACAAGATAGCA
TTAGTTCACAAGGAAGCAGAGGAGAAGAGGGCAATGATTGAAGCCAAACGAGGTGAAGAGGTTCTT
AAGGTACAGGAAATGGCTGCTAAATACCGTGCAACTGGAACCACTCCAAAAAAGACCATTGGATGT
TTTTGA

SEQ ID NO: 321 - Medicago truncatula - protein
MAETQVKSESSSDIVLAEVTKEKKLCYVKAWEESEKTKADNKAHKHISSIAAWEDSKKAALEAELK
KIEEQLERKKARYGEIMRNKIALVHKEAEEKRAMIEAKRGEEVLKVQEMAAKYRATGTTPKKTIGC
F

SEQ ID NO: 322 - Musa acuminata - DNA
ATGTTGAATGATCACAGGCACCACCACCATCACGCCGCCGCCGCTGCTGGTGATGATGATCACGAC
GAAGGCCCCAGCGACGGCGCCGAGTTCCGTGACATCCACGAATTAGCTCCCCATTCCCACCCCAGC
CAAGGCCGGCGGAGGGAGCTGTGGGAGGGCGGCAGCCACCGATCGGCCTCCCTCTCCACCGGGAGC
GACGCCGCCAACGACGGCTTCACGAGCGTGAGCAGGGAGTTCAGCGCGATGGTCGTCGCCGGCTCC
GCCATGCACAACGGCGGCGGCAGCAACCACGACAACCACGCCGACGACGGGCTCCAGAACCAGCTC
GCGCGGATCGGGGAGGACGAGCTGGAGGAGACGAACCCGCTGGCGATCGTCCCCGACAACAACCCC
ATCCCCTCTCCCCGTCGGCCGCTGCCTGCTGGGGACTCCGGCGCCGCCAACCCTGCCGACGAGGTC
CCGGTACACCTGGTGAAGAAGGAGGAGGTGGAGTCGAAGATATCGGCATGGCAGACGGCGGAGGTC
TCCAAGATCAACAACCGCTTCAAGCGCCAGGAGGTGACCATCAACGGGTGGGAGAACGAGAAGGTG
GAGAAAGCCACGGCCTGGTTGAAGAAAGTAGAGAGGAAACTGGAGGAGCAGCGGGCGAGGGCGATG
GAGAAGATGCAGAACGACGTGGCGAAGGCGCACCACAAGGCAGCGGAGAAGCGGGCGTCGGCGGAG
GCCAAGAGGGGAACCAAGGTTGCCAAGGTGCTGGAACTGGCCAACTTCATGAGAGCTGTGGGGAGA
GCTCCGTCCAAGCGCTCCTTCTTCTAG

SEQ ID NO: 323 - Musa acuminata - protein
MLNDHRHHHHHAAAAAGDDDHDEGPSDGAEFRDIHELAPHSHPSQGRRRELWEGGSHRSASLSTGS
DAANDGFTSVSREFSAMVVAGSAMHNGGGSNHDNHADDGLQNQLARIGEDELEETNPLAIVPDNNP
IPSPRRPLPAGDSGAANPADEVPVHLVKKEEVESKISAWQTAEVSKINNRFKRQEVTINGWENEKV
EKATAWLKKVERKLEEQRARAMEKMQNDVAKAHHKAAEKRASAEAKRGTKVAKVLELANFMRAVGR
APSKRSFF

SEQ ID NO: 324 - Medicago truncatula - DNA
ATGTCAAATAATTTTCTTTCATCAAACCAATCAGATTCATATTCTTGTTCATCTTCTTGTTGTTTA
ACAAGAACATTGAAAACAAAGCGTGGAAATAAAAATAAGAAGATGCATCGTTCTCTCATCACAGCA
TTGCAAGAATCTCCTTCTTCTAATTACCATTCTCTTCCTGATCCTCCCTCATGCTCAGACAATGCG
ACTCACTTCTCCACTCCAAGAAACCAGAGATTAGGCATGGCCCACATTGAAACAATTGCTTCTCT
GATATTGATGAATGGTTGGAACATGCCAATAAGTTTTGCAAATCCTTCTTCAATCATCATCACACT
GAGGAAAATCTTGAAGCAGAAACAAGGCAAAATGGAAATCCACAAGACTTGATGAGAATGTCAGCA FIGURE 22 (continued)

```
GTATGCAACAAGGACCTAACAGCTCAAGAGCATGAATTTTACAACATAGTATTACCCTCAGTTAGA
GAAGAAAGTCCACTTCCTCGTACTATTACCTCCTGCATAAACAGACATGGAGGGTGCAGCAGCAAT
CCCAAACTTGAAGCTGATCATGAAGATGTACGTAACAAAGCCAAGCATCTTCAACTTATGCACAGG
TTGAGAAAGAAGGAAGAAGCTATAAATGATTGGGAATTGCACCAAACCAGGAAAGCCATGGATAAC
ATGGATAAAATTCAGAATAAGCTTGAAAGGAAACAAGTAATGGCTTCAGCAAGGGCTCAAAAGAAA
ATATACTCAGTAAGGGAAAAGGCAGAGAAGCAAAAGCTGAACTTAAGGCGATCAACTATGAAAAG
TTCCAACAACTACAAATACATGAGACTCATTCCTCCTCAGATACTTCATGGGACTCACATTTGCCT
TTATGTTAA
```

SEQ ID NO: 325 - Medicago truncatula - protein
```
MSNNFLSSNQSDSYSCSSSCCLTRTLKTKRGNKNKKMHRSLITALQESPSSNYHSLPDPPSCSDNA
THFSTPRNQRLGMAHIENNCFSDIDEWLEHANKFCKSFFNHHHTEENLEAETRQNGNPQDLMRMSA
VCNKDLTAQEHEFYNIVLPSVREESPLPRTITSCINRHGGCSSNPKLEADHEDVRNKAKHLQLMHR
LRKKEEAINDWELHQTRKAMDNMDKIQNKLERKQVMASARAQKKIYSVREKAEKQKLNLRRSTMKK
FQQLQIHETHSSSDTSWDSHLPLC
```

SEQ ID NO: 326 - Arath_Remorin, Remorin domain comprised in SEQ ID NO: 2
```
VKREEVEAKITAWQTAKVAKINNRFKRQDAVINGWLNEQVHRANSWMKKIERKLEDRRAKAMEKTQ
NKVAKAQRKAEERRATAEGKRGTEVARVLEVANLMRAVGRPPAKR
```

SEQ ID NO: 327 - prm09186
```
GGGGACAAGTTTGTACAAAAAAGCAGGCTTAAACAATGTTGACTTTGTACGGTCAA
```

SEQ ID NO: 328 - prm09187
```
GGGGACCACTTTGTACAAGAAAGCTGGGTAGCTTAGCTAGGAAAGAGAGAA
```

SEQ ID NO: 329 - Oryza sativa GOS2 promoter
```
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAGGGGATCTGTATCTGTGATGATTCC
TGTTCTTGGATTTGGGATAGAGGGGTTCTTGATGTTGCATGTTATCGGTTCGGTTTGATTAGTAGT
```

FIGURE 22 (continued)

```
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

SEQ ID NO: 330 - Oryza sativa high mobility group B (HMGB) promoter
```
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGCGGGGTGTAGCGGGTGCGAAAAGGAGGCGATCGGTACGAAAATTCAAAT
TAGGAGGTGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGGCCTTCTCGCAGG
ATTCAGCC
```

SEQ ID NO: 331, Rice HMGB promoter variant
```
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
```

FIGURE 22 (continued)

```
CGCGCGTCATCGCGGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGGCCTTCTCGCAGG
ATTCAGCC
```

SEQ ID NO: 332, Zea mays Remorin
```
GGCACAGACGCTACTGGCACGCACGCACGCACCAGCACCACACCACACCACATGCATGGTGGAGCC
TAGCACGGGCAGCTAGCTCCCGGCCGGCGACGTGACGACCACCACCACCACATGTTGCATGAGCAG
CAGGCACCGCCACCGGCAGTAGCAGCGCCACCGCCATCCATCAACCCCGACGACGACGGCGGCCGC
GATGTCGAGGTCACCACGTTCCGCGACATCCACCCTCTGACGCCCGACGCGCCGCCGCCCGCCTCC
GCGTCCTGGGACACGGCCAGCCACCGCTCCTTCTCGTCGTCCGACGACCAGCAGTACATGACGATG
AGCCGCGAGTTCACGGCCATGGTCGCCGCCGGGGCGACCATGCAGACCGGCGGCTACGACGGCGCC
GCCGACCAGCTCACCAGCATCGGCGAGGACGAGCTGGAGGAGACCAACCCGCTGGCCATCGTCCCC
GACAGCCACCCCATCGCCACGCCAGCCAGGTCCAGGGCGTCCGGGCTGGAGGTCGTGCCCGCGGGC
CCGGCGCCGGCGCCGCAGCCGCCCGCGCACCTGGAGGCCAGCCAGGTCAAGAAGGAGGAGGTGGAG
ACCAAGGTCACGGCCTGGCAGACGGCCGAGGTCGCCAAGATCAACAACCGCTTCAAGAGGGAGGAT
GTGGTCATCAACGGCTGGGAGACCGAGCAGGTGGAGAAGGCCTCCGCGTGGCTCAAGAAGATCGAG
AGGAAGCTGGACGAGCAGCGCGCCAAGGCGCTGGAGAAGACGCAGAACGACATCGCCAAGGCGCGG
CGCAAGGCGGAGGAGAAGCGGGCGTCGGCGGAGGCCAAGCGGGGCCTCAAGCTGGCCAAGGTGCTG
GAGCTCGCCAACTTCATGAAGGCCGTCGGCAGGGTGCCCACCAAGCGCTCCTTCTTCTAGCCAGCC
GACTACCCCGTCTCTCCCTGCCTGCGTGTGATCGATGTACGCTCGCTGCTGCATCCGAGAACCTA
ACTGTAAAGAAAAAAAAACTGTAAGCTGTATACGTACTGCGCCTGCTGGTTCCCCTGTGATGTCTG
TCAGTGTCATCCATCACAGGGTGCCAGTTGTTCTCTTCTCTTTCTTTTCTTTTCTCTTCTCTTGGC
TTGTATATCGGATCCATATATGCTGGTGGTGCTTGAACGAACTGTTGTTGTTTGCTTAACCGTGCA
AACATATACAGTGGTATATACACTACATTCAGAACCCAAAAAAAAAAAAAAAAAA
```

SEQ ID NO: 333, Zea mays Remorin, deduced protein sequence
```
MLHEQQAPPPAVAAPPPSINPDDDGGRDVEVTTFRDIHPLTPDAPPPASASWDTASHRSFSSSDDQ
QYMTMSREFTAMVAAGATMQTGGYDGAADQLTSIGEDELEETNPLAIVPDSHPIATPARSRASGLE
VVPAGPAPAPQPPAHLEASQVKKEEVETKVTAWQTAEVAKINNRFKREDVVINGWETEQVEKASAW
LKKIERKLDEQRAKALEKTQNDIAKARRKAEEKRASAEAKRGLKLAKVLELANFMKAVGRVPTKRS
FF
```

SEQ ID NO: 334 C-terminal sequence of SEQ ID NO: 333
```
VKKEEVETKVTAWQTAEVAKINNRFKREDVVINGWETEQVEKASAWLKKIERKLDEQRAKALEKTQ
NDIAKARRKAEEKRASAEAKRGLKLAKVLELANFMKAVGRVPTKR
```

FIGURE 22 (continued)

| | | 1 | | | | 50 |
|---|---|---|---|---|---|---|
| Os01g0968800 | (1) | ------------------------------------------------- | | | | |
| Os02g0677300 | (1) | ------------------------------------------------- | | | | |
| Os06g0127100 | (1) | ------------------------------------------------- | | | | |
| Os06g0165600 | (1) | ------------------------------------------------- | | | | |
| Os08g0545400 | (1) | ------------------------------------------------- | | | | |
| Os08g0545500 | (1) | ------------------------------------------------- | | | | |
| Os09g0522000 | (1) | ------------------------------------------------- | | | | |
| Os09g0522100 | (1) | ------------------------------------------------- | | | | |
| Os09g0522200 | (1) | ------------------------------------------------- | | | | |
| At1g46768 | (1) | MAAAMNLYTCSRSFQDSGGELMDALVPFIKSVSDSPSSSSAASASAFLHP | | | | |
| AT1G78080 | (1) | ----------------------------------------------MAVYE | | | | |
| At2g40220 | (1) | ------------------------------------------------- | | | | |
| At3g11020 | (1) | ------------------------------------------------- | | | | |
| At4g25480 | (1) | ------------------------------------------------- | | | | |
| AT4G25490 | (1) | ----------------------------------------------MAVYD | | | | |
| At5g05410 | (1) | ------------------------------------------------- | | | | |
| At5g25810 | (1) | ------------------------------------------------- | | | | |
| At4g25470 | (1) | ------------------------------------------------- | | | | |
| At4g36900 | (1) | ------------------------------------------------- | | | | |
| Consensus | (1) | | | | | |

FIGURE 24

```
Os01g0968800   (1)  ------------------------------------------------------   ---MDTEDTSSASSSSVSPFSSPGG
Os02g0677300   (1)  ------------------------------------------------------   MDVSAALSSDYSSGTPSPVAADADDGSSAY
Os06g0127100   (1)  ------------------------------------------------------   ------------MEYYE--------QEEY
Os06g0165600   (1)  ------------------------------------------------------   ------------------------
Os08g0545400   (1)  ------------------------------------------------------   -------MEKNTAASGQLMTSSAEATP
Os08g0545500   (1)  ------------------------------------------------------   ---MDVARDMEKNTTAMGQLMSSSATTAA
Os09g0522000   (1)  ------------------------------------------------------   -------MCTSKLEEITGEWPPPALQAASTTSSS
Os09g0522100   (1)  ------------------------------------------------------   ----------------------MEVEEAAY
Os09g0522200   (1)  ------------------------------------------------------   ---MDMAGHEVNSSSSSSGAESSS
At1g46768      (1)  ------------------------------------------------------   ---MCGIKQEMSGESSGPCSSASAERQH
AT1G78080     (51)  SAFSLPPLPGYYPDSTFLTQPFSYGSDLQQTGSLIGLNNLSSSQIHQIQS   -----MEREQEESTMR-----
At2g40220      (1)  ------------------------------------------------------   MDPLASQHQHNHLEDNNQTLTHNNPQSDS
At3g11020      (6)  QTGTE-----QPKKRKSRARAGGLTVADRLKKWKEYNEIVEASAVKEGE   --------------------------
At4g25480      (1)  ------------------------------------------------------   MNSFSAFSEMFGSDYESSVSSGGDYI
AT4G25490      (1)  ------------------------------------------------------   MNSFSAFSEMFGSDYEP----QGGDYC
At5g05410      (6)  QSGDRNRTQIDTSRKRKSRSRGDGTTVAERLKRWKEYNETVEEVSTK--   --------------------------
At5g25810      (1)  ------------------------------------------------------   -----------------MIASESTKSWE
At4g25470      (1)  ------------------------------------------------------   MNSFSAFSEMFGSDYESPVSSGGDYS
At4g36900      (1)  ------------------------------------------------------   -----------------METATEVATVV--
Consensus     (51)                                                             S
```

FIGURE 24 (continued)

```
                          101                                                                  150
Os01g09968800      (23)   GHHHRLPPK-----------------------------RRAGRKK-------------FRETRHP
Os02g0677300       (31)   MTVSSAPPK-----------------------------RRAGRTK-------------FKETRHP
Os06g0127100       (10)   ATVTSAPPK-----------------------------RPAGRTK-------------FRETRHP
Os06g0165600       (21)   ----SSPK------------------------------RPAGRTK-------------FQETRHL
Os08g0545400       (27)   TATGPASPK-----------------------------RPAGRTK-------------FQETRHP
Os08g0545500       (28)   EPCRRLSPPSS---------------------------KRPAGRTK------------FHETRHP
Os09g0522000        (9)   RTVWSEPPK-----------------------------RPAGRTK-------------FHETRHP
Os09g0522100       (22)   SSSGRQQYKK----------------------------RPAGRTK-------------FRETRHP
Os09g0522200       (27)   QTVWTAPPK-----------------------------RPAGRTK-------------FRETRHP
At1g46768          (12)   --KRRQPPQEE---------------------------VPNHVATR------------------K
AT1G78080         (101)   QIHHPLPPTHHNNNNSFSNLLSPKPLLMKQSGVAGSCFAYGSGVPSKPTK
At2g40220          (30)   TTDSSTSSAQR---------------------------KRKGKGG-------------PDNSKF
At3g11020          (50)   KPKRKVPAKGS---------------------------KKGCMKGKG----------GPDNSHC
At4g25480          (27)   PTLASSCPK-----------------------------KPAGRKK-------------FRETRHP
AT4G25490          (24)   PTLATSCPK-----------------------------KPAGRKK-------------FRETRHP
At5g05410          (53)   --KRKVPAKGS---------------------------KKGCMKGKG----------GPENSRC
At5g25810          (12)   ASAVRQENE-----------------------------EEKKKPV------------KDSGKHP
At4g25470          (27)   PKLATSCPK-----------------------------KPAGRKK-------------FRETRHP
At4g36900          (12)   --STPAVTVAA---------------------------VATRKRD------------------K
Consensus         (101)                                         RPAGR K              F ETRHP
```

FIGURE 24 (continued)

```
                    151                                                              200
Os01g0968800  (46)  VYRGVRARAG----GSRWCEVREPQAQ-ARIWLGTYPTPEMAARAHDVA
Os02g0677300  (54)  VFKGVRRRN-----PGRWCEVREPHGK-QRIWLGTFETAEMAARAHDVA
Os06g0127100  (33)  VYRGVRRRGP----AGRWCEVREPNKK-SRIWLGTFATAEAAARAHDVA
Os06g0165600  (39)  VFRGVRWRGC----AGRWCKVRVPGSRGDRFWIGTSDTAEETARTHDAA
Os08g0545400  (50)  VFRGVRRRGR----AGRWCEVRVPGSRGDRLWVGTFDTAEEAARAHDAA
Os08g0545500  (54)  VFRGVRRRGR----AGRWCEVRVPGRRGCRLWLGTFDAADAAARAHDAA
Os09g0522000  (32)  VYRGVRRRGGRPGAAGRWCEVRVPGARGSRLWLGTFATAEAAARAHDAA
Os09g0522100  (46)  VYRGVRRRGG----AGRWCEVRVPGKRGARLWLGTYVTAEAAARAHDAA
Os09g0522200  (50)  VFRGVRRRGN----AGRWCEVRVPGRRGCRLWLGTFDTAEGAARAHDAA
At1g46768     (30)  PYRGIRRRK-----WGKWVAEIREPNKR-SRLWLGSYTTDIAAARAYDVA
AT1G78080    (151)  LYRGVRQRH-----WGKWVAEIRLPRNR-TRLWLGTFDTAEEAALAYDKA
At2g40220     (54)  RYRGVRQRS-----WGKWVAEIREPRKR-TRKWLGTFATAEDAARAYDRA
At3g11020     (77)  SFRGVRQRI-----WGKWVAEIREPKIG-TRLWLGTFPTAEKAASAYDEA
At4g25480     (50)  IYRGVRRRNS----GKWVCEVREPNKK-TRIWLGTFQTAEMAARAHDVA
AT4G25490     (47)  IYRGVRQRNS----GKWVSEVREPNKK-TRIWLGTFQTAEMAARAHDVA
At5g05410     (78)  SFRGVRQRI-----WGKWVAEIREPNRG-SRLWLGTFPTAQEAASAYDEA
At5g25810     (35)  VYRGVRKRN-----WGKWVSEIREPRKK-SRIWLGTFPSPEMAARAHDVA
At4g25470     (50)  IYRGVRQRNS----GKWVCELREPNKK-TRIWLGTFQTAEMAARAHDVA
At4g36900     (29)  PYKGIRMRK-----WGKWVAEIREPNKR-SRIWLGSYSTPEAAARAYDTA
Consensus    (151)  VYRGVRRR         GKWVCEVREP KR SRLWLGTF TAE AARAHD A
```

FIGURE 24 (continued)

```
                  201                                                        250
Os01g0968800  (91) AIALRG------ERGAELNFPDSPSTLPRARTAS------PEDIRLAAAQA
Os02g0677300  (98) ALALRG------RAACLNFADSPRRLRVPPIG------ASHDDIRRAAAEA
Os06g0127100  (78) ALALRG------RGACLNFADSARLLRVDPATL------ATPDDIRRAAIEL
Os06g0165600  (85) MLALCG------ASASLNFADSAWLLHVPRAPVVSG--LRPPAARCATRC
Os08g0545400  (96) MLALCG------ASASLNFADSAWLLHVPRAPVASGHDQLPDVQRAASEA
Os08g0545500 (100) MLALRG------RAAACLNFADSAWLLAVPPPA--TLRCAADVQRAVARAL
Os09g0522000  (82) ALALRG------RAACLNFADSAWRMPPVPAS-AALAGARGVRDAVAVAV
Os09g0522100  (92) MIALRGGAGGG-GAACLNFQDSAWLLAVPPAAPSDLAGVR----RAATEAV
Os09g0522200  (96) MLAINAGGGGGGACCLNFADSAWLLAVPRSY-RTLADVR---HAVAEAV
At1g46768    (74) VFYLRG------PSARLNFPDLLLQEEDHLSAAT----TADMPAALIREK
AT1G78080   (195) AYKLRG------DFARLNFPNLRHNGSHIGGDFGEYKPLHSSVDAKLEAI
At2g40220    (98) AVYLYG------SRAQLNLTPSSPSSVSSSSSSVSAASSPSTSSSSTQTL
At3g11020   (121) ATAMYG------SLARLNFPQSVGSEFTSTSSQSEVCTVENKAVVCGDVC
At4g25480    (94) ALALRG------RSACLNFADSAWRLRIPEST------CAKDIQKAAAEA
At4g25490    (91) ALALRG------RSACLNFADSAWRLRIPEST------CAKDIQKAAAEA
At5g05410   (122) AKAMYG------PLARLNFPRSDASEVTSTSSQSEVCTVETP----GCVH
At5g25810    (79) ALSIKG------ASAILNFPDLAGSFPRPSSLS------PRDIQVAALKA
At4g25470    (94) AIALRG------RSACLNFADSAWRLRIPEST------CAKEIQKAAAEA
At4g36900    (73) VFYLRG------PSARLNFPELLAGVTVTGGGGGVNGGGDMSAAYIRRK
Consensus   (201) ALALRG            SA LNFADSA     L  VP S             AA
```

FIGURE 24 (continued)

| | | 251 | | 300 |
|---|---|---|---|---|
| Os01g0968800 | (130) | AELYRRPPPPLAL | ------------------------------------ | -PEDPQEGTSG |
| Os02g0677300 | (137) | AEAFRPPPDESNA | ------------------------------------ | -ATEVAAAASG |
| Os06g0127100 | (118) | AESCPHDAAAAAA | ------------------------------------ | -SSSAAAVEAS |
| Os06g0165600 | (127) | LQGHRRVPAPGRG | ------------------------------------ | -STATATATSG |
| Os08g0545400 | (140) | VAEFQRRGS---- | ------------------------------------ | -TAATATATSG |
| Os08g0545500 | (143) | EDFEQRESSSSVF | ------------------------------------ | -PLAIDVVAED |
| Os09g0522000 | (125) | EAFQRQ------- | ------------------------------------ | -SAAPSSPAET |
| Os09g0522100 | (138) | AGFLQRNKTTNGA | ------------------------------------ | -SVAEAMDEAT |
| Os09g0522200 | (142) | EDFFRR------- | ------------------------------------ | -RLADDALSAT |
| At1g46768 | (114) | AAEVGARVDALLA | ------------------------------------ | -SAAP------ |
| AT1G78080 | (239) | CKSMAETQKQDKS | ------------------------------------ | -TKSSKKREKK |
| At2g40220 | (142) | RPLLPRPAAATVGGGANFGPYGIPFNNNIFLNGGTSMLCPSYGFFPQQQQ | | |
| At3g11020 | (165) | VKHEDTDCESNPF | ------------------------------------ | -SQILDVREES |
| At4g25480 | (132) | ALAFQDEMCDATT | ------------------------------------ | -D-HGFDMEET |
| AT4G25490 | (129) | ALAFQDETCDTTT | ------------------------------------ | -TNHGLDMEET |
| At5g05410 | (162) | VKTEDPDCESKPF | ------------------------------------ | -SGGVEP---- |
| At5g25810 | (117) | AHMETSQSFSSSS | ------------------------------------ | -SLTFSSSQSS |
| At4g25470 | (132) | ALNFQDEMCHMTT | ------------------------------------ | -DAHGLDMEET |
| At4g36900 | (117) | AAEVGAQVDALEA | ------------------------------------ | -AGAGGN---- |
| Consensus | (251) | A | | S A |

FIGURE 24 (continued)

```
                         301                                                                              350
Os01g0968800   (153)     GGATATSGRP----------------------------------------------------AAVF
Os02g0677300   (160)     ATNSNAEQFASHPYYEVMD------------------------D--G-------LDLGM
Os06g0127100   (141)     AAAAPAMMMQYQDDMAATP------------------------S--S-------YDYAY
Os06g0165600   (150)     DAASTAPP--SAPVLSAKQCEFIFLSSLDCWMLMSKLISSSRAKGSLCLRK
Os06g0545400   (159)     DAASTAPPSSSPVLSPN--------------------DDNASSASTPAVAAALDH
Os08g0545500   (166)     AMSATSEPSAASDDDAVTSS-----------SSTTDADEEAS---PFELDV
Os08g0545410   (141)     F-ANDGDEEEDNKDVLPVAA-----------AEVFDAG------AFELDD
Os09g0522000   (161)     SGVSAPPPLANNAGSSETPG-----------PSSIDGTADTAAGAALDMFE
Os09g0522100   (158)     S--SSSTTPSTPRTDDDEESA----------ATDGDESSSPASDLAFELDV
Os09g0522200   (131)     -----------------------------------------------VSIGG
At1g46768      (262)     VSSPDLSEKVKAEENS-----------------------------------
AT1G78080      (192)     QQNQMVQMGQFQHQQYQNLHSNTNNNKISDIELTDVPVTNSFHHEVAL
At2g40220      (188)     CGTRPDSCTVGHQDMNSSLN-----------YDLLLEFEQQYWGQVLQ
At3g11020      (154)     LVEAIYTA-----EQS--------------E--N------AFYMHD
At4g25480      (152)     MVEAIYTP-----EQS--------------E--G------AFYMDE
At4g25490      (181)     --MYCLENGAEEMKRGVKAD----------KHWLSEFEHNYWSDILK
At5g05410      (140)     SSLESLVSSSATGSEE--------------LGEIVELPSL
At5g25810      (155)     LVEAIYTP-----EQS--------------Q--D------AFYMDE
At4g25470      (136)     ------RHHHHHQHQRGN------------HDYVDNHSDYRINDDLM
At4g36900
Consensus      (301)                          A                      D                              L
```

FIGURE 24 (continued)

```
                          351                                                          400
Os01g0968800   (167) VDEDAI------------FDMPGLIDDMARGMMLTPPAIGRSLDDWAAIDDDD
Os02g0677300   (186) QGYLDM------------AQGMLIDPPP-------------MAGDPAVGSGED
Os06g0127100   (167) YGNMDF------------DQPSYYYDGMGGGGEYQSWQ---MDGDDGGAG-G
Os06g0165600   (199) NPISFC------------MVTNSYTALLLEYIILQMNS--MIVLIHELSKYQV
Os08g0545400   (194) GDMFGG------------MRTDLYFASLAQGLLIEPPP--PPTTAEGFCDDEG
Os08g0545500   (203) VSDMG-------------WSLYYASLAEGLLMEPPASGASSDDDDAIVDS
Os09g0522000   (173) GFRFGG------------MDAGSYYASLAQGLLVEPPAAGAWWEDGELAGSD-
Os09g0522100   (201) LDFFGE------------MDYDTYYASLAEGLLMEPPAATALWDNGDEGAD-
Os09g0522200   (197) LSDMG-------------WDLYYASLAQGMLMEPPS-AALGDDGDAILAD-
At1g46768      (131) ------------------SMAHSTPPVIKPDLNQIPESGDI----
At1G78080      (283) SPPVTE------------FEESTAGSSPLSDLTFADPEEPPQWNETFSLEKYP
At2g40220      (242) GQEQGGSGCNNNSSMEDLNSLAGSVGSSLSITHPPLVDPVCSMGLDPGY
At3g11020      (225) EKEKPK------------QEEEEIQQQQQEQQQQQLQPDLLTVADYGWPWSND
At4g25480      (173) EAMFE-------------MPSLLANMAEGMLLPLPS--VQWNHNHEVDGD-
AT4G25490      (171) ETMFG-------------MPTLLDNMAEGMLLPPPS--VQWNHNYDGEG--
At5g05410      (216) EKEK--------------QKEQGIVETCQ-QQQQ----DSLSVADYGLNQDRY
At5g25810      (166) GSSYDG------------LTQLGNEFIFSDSADLWPYPPQWSEGDYQMIPASL
At4g25470      (174) EAMLG-------------MSSLLDNMAEGMLLPSPS--VQWNYNFDVEG--
At4g36900      (165) ECSS--------------KEGFKRCNGSLERVDLNKLPDPETSDDD-
Consensus      (351)                    LA GLLL  P             D
```

FIGURE 24 (continued)

```
                        401                                                                    450
Os01g0968800   (208)    DHYHMDYKLWMD---------------------------------------
Os02g0677300   (214)    -DNDGEVQLWSY---------------------------------------
Os06g0127100   (204)    -YGGGDVTLWSY---------------------------------------
Os06g0165600   (238)    -FLLLTMITHHLFQWRR----------------------------------
Os08g0545400   (233)    -CGGAEMELWS----------------------------------------
Os08g0545500   (241)    -SDIADVSLWSY---------------------------------------
Os09g0522000   (213)    ------MPLWSY---------------------------------------
Os09g0522100   (241)    ------IALWSY---------------------------------------
Os09g0522200   (233)    ------VPLWSY---------------------------------------
At1g46768      (154)    ---------------------------------------------------
AT1G78080      (324)    SYEIDWDSILA----------------------------------------
At2g40220      (292)    MVGDGSSTIWPFGGEEEYSHNWGSIWDFIDPILGEFY--------------
At3g11020      (266)    -IVNDQTSWDPNECFDINELLGDLNEPGPHQSQDQNHVNSGSYDLHPLHL
At4g25480      (208)    ---DDDVSLWSY---------------------------------------
AT4G25490      (205)    ---DGDVSLWSY---------------------------------------
At5g05410      (250)    -PG----------N-SVANGSYRP-ESQQSGFDPLQSLNYGIPPFQL----
At5g25810      (207)    SQDWDLQGLYNY---------------------------------------
At4g25470      (208)    ---DDDVSLWSY---------------------------------------
At4g36900      (197)    ---------------------------------------------------
Consensus      (401)            V LWSY
```

FIGURE 24 (continued)

| | | 451 | | 469 |
|---|---|---|---|---|
| Os01g09968800 | (220) | ------------------- | | |
| Os02g06773300 | (225) | ------------------- | | |
| Os06g01271100 | (215) | ------------------- | | |
| Os06g01656600 | (254) | ------------------- | | |
| Os08g05454400 | (243) | ------------------- | | |
| Os08g05455500 | (252) | ------------------- | | |
| Os09g05222000 | (219) | ------------------- | | |
| Os09g05221100 | (247) | ------------------- | | |
| Os09g05222200 | (239) | ------------------- | | |
| At1g46768 | (154) | ------------------- | | |
| AT1G78080 | (335) | EPHDG-HEFNGLSSLDI-- | | |
| At2g40220 | (329) | ------------------- | | |
| At3g11020 | (315) | ------------------- | | |
| At4g25480 | (217) | ------------------- | | |
| AT4G25490 | (214) | ------------------- | | |
| At5g05410 | (284) | EGKDGNGFFDDLSYLDLEN | | |
| At5g25810 | (219) | ------------------- | | |
| At4g25470 | (217) | ------------------- | | |
| At4g36900 | (197) | ------------------- | | |
| Consensus | (451) | | | |

FIGURE 24 (continued)

SEQ ID NO: 335, Oryza sativa - DNA

ATCGCCATTACCACACTCGAGCAGAGCAAATACAGTTCAGGAATCAGGAGCAAGCAGAAACACACA
CACAAATCCGAAGATGTGCGGGATCAAGCAGGAGATGAGCGGCGAGTCGTCGGGGTCGCCGTGCAG
CTCGGCGTCGGCGGAGCGGCAGCACCAGACGGTGTGGACGGCGCCGCCGAAGAGGCCGGCGGGGCG
GACCAAGTTCAGGGAGACGAGGCACCCGGTGTTCCGCGGCGTGCGGCGGAGGGGCAATGCCGGGAG
GTGGGTGTGCGAGGTGCGGGTGCCCGGGCGGCGCGGCTGCAGGCTCTGGCTCGGCACGTTCGACAC
CGCCGAGGGCGCGGCGCGCGCGCACGACGCCGCCATGCTCGCCATCAACGCCGGCGGCGGCGGCGG
CGGGGGAGCATGCTGCCTCAACTTCGCCGACTCCGCGTGGCTCCTCGCCGTGCCGCGCTCCTACCG
CACCCTCGCCGACGTCCGCCACGCCGTCGCCGAGGCCGTCGAGGACTTCTTCCGGCGCCGCCTCGC
CGACGACGCGCTGTCCGCCACGTCGTCGTCCTCGACGACGCCGTCCACCCCACGCACCGACGACGA
CGAGGAGTCCGCCGCCACCGACGGCGACGAGTCCTCCTCCCCGGCCAGCGACCTGGCGTTCGAACT
GGACGTCCTGAGTGACATGGGCTGGGACCTGTACTACGCGAGCTTGGCGCAGGGGATGCTCATGGA
GCCACCATCGGCGGCGCTCGGCGACGACGGTGACGCCATCCTCGCCGACGTCCCACTCTGGAGCTA
CTAGAGCTCAATCAACTGTACAATTTTGCCTCTTTTTCTCTCTTTTCTGGCTTCCGATGCCAAAA
TTTTGGTACTGTACGGACACTACTTTCGGTAATGTGATGGAACAAGTTGCAAAACACAGAGC

SEQ ID NO: 336, Oryza sativa - protein

MCGIKQEMSGESSGSPCSSASAERQHQTVWTAPPKRPAGRTKFRETRHPVFRGVRRRGNAGRWVCE
VRVPGRRGCRLWLGTFDTAEGAARAHDAAMLAINAGGGGGGACCLNFADSAWLLAVPRSYRTLAD
VRHAVAEAVEDFFRRRLADDALSATSSSSTTPSTPRTDDDEESAATDGDESSSPASDLAFELDVLS
DMGWDLYYASLAQGMLMEPPSAALGDDGDAILADVPLWSY

SEQ ID NO: 337, Artificial sequence - primer 1

GGGGACAAGTTTGTACAAAAAAGCAGGCTTAAACAATGTGCGGGATCAAGCA

SEQ ID NO: 338, Artificial sequence - primer 2

GGGGACCACTTTGTACAAGAAAGCTGGGTGGCAAAATTGTACAGTTGATTG

SEQ ID NO: 339, Oryza sativa - gos2 promoter

AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG

FIGURE 27

```
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

SEQ ID NO: 340, Artificial sequence - consensus sequence of an AP2 domain as provided in the SMART database

```
.a+GVp.+.hG.+W.ucItcs..........ttclaLGoFsot-tAAhAYD.AAhhhhG..pAhhN
Fs....tt
```

SEQ ID NO: 341, Artificial sequence - consensus sequence of AP2 domain of SEQ ID NO: 336

```
VFRGVRRRGNAGRWVCEVRVPGRRGCRLWLGTFDTAEGAARAHDAAMLAINAGGGGGGACCLNFA
DSAWLL
```

SEQ ID NO: 342, Artificial sequence – DRE element

(G/a)(C/t)CGAC

SEQ ID NO: 343, Artificial sequence - motif CMIII-1

PELAWSLPRPESTSPKDIQAAAAEAAAMF

SEQ ID NO: 344, Artificial sequence - motif CMIII-2

QSCGAFFMDEEAMLGMPNLLANMAEGMLLPPP

SEQ ID NO: 345, Artificial sequence - motif CMIII-3

DYDPTLAESCPKKPAGRKKFR

FIGURE 27 (continued)

SEQ ID NO: 346, Artificial sequence - motif CMIII-4

LWSY

SEQ ID NO: 347, Artificial sequence - motif CMIII-3 region I

(P/R)KKPAGRxKFxETRHP

SEQ ID NO: 348, Artificial sequence - motif CMIII-3 region II

DSAWR

SEQ ID NO: 349, Artificial sequence - motif CMIV-1

KGKGGPxN

SEQ ID NO: 350, Artificial sequence - motif CMIV-2

KKRKRRGGRDVAEILKKWKEYNEQVEADSCIDGGGPKKIRK

SEQ ID NO: 351, Oryza sativa - DNA

ATGTGTACGAGCAAACTAGAGGAGATCACCGGCGAGTGGCCGCCGCCGGCATTGCAGGCCGCCTCC
ACGACGTCGTCGTCGGAGCCGTGCCGCCGCCTCTCGCCGCCCAGCAGCAAGCGCCCCGCGGGGCGC
ACCAAGTTCCACGAGACCCGCCACCCGGTGTTCCGCGGCGTGCGGCGCCGCGGCCGCGCGGGGCGG
TGGGTGTGCGAGGTCCGCGTGCCGGGCCGCCGCGGGTGCAGGCTCTGGCTCGGCACGTTCGACGCC
GCCGACGCCGCCGCGCGCGCCCACGACGCCGCCATGCTCGCGCTCCGCGGCCGCGCCGCCGCGTGC
CTCAACTTCGCCGACTCCGCCTGGCTGCTCGCCGTGCCGCCCCCGGCCACCCTCCGCTGCGCCGCC
GACGTCCAGCGCGCCGTGGCGCGGGCGCTGGAGGACTTCGAGCAGCGGGAGTCATCATCGTCCGTG
TTCCCACTCGCCATCGACGTCGTCGCCGAGGACGCCATGTCCGCCACGTCCGAGCCGTCCGCCGCG
AGCGACGACGACGCCGTCACCAGCAGCAGCAGCACGACCGACGCCGACGAGGAGGCATCACCGTTC
GAGCTGGACGTGGTGAGCGACATGGGCTGGAGCCTGTACTACGCGAGCTTAGCGGAGGGCCTCCTC
ATGGAGCCGCCGGCTTCCGGCGCATCGTCCGACGACGACGACGACGCCATCGTCGACTCAAGCGAC
ATCGCTGACGTGTCTCTGTGGAGCTACTAG

SEQ ID NO: 352, Oryza sativa - protein

MCTSKLEEITGEWPPPALQAASTTSSSEPCRRLSPPSSKRPAGRTKFHETRHPVFRGVRRRGRAGR
WVCEVRVPGRRGCRLWLGTFDAADAAARAHDAAMLALRGRAAACLNFADSAWLLAVPPPATLRCAA
DVQRAVARALEDFEQRESSSSVFPLAIDVVAEDAMSATSEPSAASDDDAVTSSSSTTDADEEASPF
ELDVVSDMGWSLYYASLAEGLLMEPPASGASSDDDDDAIVDSSDIADVSLWSY

SEQ ID NO: 353, Oryza sativa - DNA

ATGGACATGGCCGGCCACGAGGTGAACTCCAGCTCGTCGTCGTCGGGGGCGGAGTCGTCGTCGTCC
TCGTCGGGGCGGCAGCAGTACAAGAAGCGGCCCGCGGGGCGCACCAAGTTCAGGGAGACGCGGCAC
CCGGTGTACCGCGGCGTGCGGCGCCGCGGCGGGCGGGGCGGTGGGTGTGCGAGGTGCGCGTCCCG
GGGAAGCGCGGCGCGCGCCTGTGGCTCGGCACGTACGTCACCGCCGAGGCCGCGGCGCGCGCGCAC

FIGURE 27 (continued)

```
GACGCCGCCATGATCGCGCTCCGCGGCGGCGCCGGCGGAGGCGGCGCGGCGTGCCTCAACTTCCAG
GACTCCGCGTGGCTGCTCGCCGTCCCGCCCGCCGCGCCGTCCGACCTGGCCGGCGTCCGCCGCGCG
GCCACCGAGGCCGTCGCGGGCTTCCTCCAGCGCAACAAGACCACGAACGGCGCCTCCGTCGCGGAG
GCCATGGACGAGGCCACCTCCGGCGTGTCCGCGCCGCCGCCGCTGGCCAACAATGCCGGCTCGTCG
GAGACGCCCGGACCTTCATCGATCGACGGAACGGCTGACACGGCGGCGGGGGCGGCGCTGGACATG
TTCGAGCTCGACTTCTTCGGCGAAATGGACTACGACACGTACTACGCGAGCCTGGCCGAGGGGCTT
CTCATGGAGCCGCCGCCGGCGGCGACCGCACTCTGGGACAACGGCGACGAAGGCGCTGACATCGCG
CTCTGGAGCTACTGA
```

SEQ ID NO: 354, Oryza sativa - protein

```
MDMAGHEVNSSSSSSGAESSSSSSSGRQQYKKRPAGRTKFRETRHPVYRGVRRRGGAGRWVCEVRVP
GKRGARLWLGTYVTAEAAARAHDAAMIALRGGAGGGGAACLNFQDSAWLLAVPPAAPSDLAGVRRA
ATEAVAGFLQRNKTTNGASVAEAMDEATSGVSAPPPLANNAGSSETPGPSSIDGTADTAAGAALDM
FELDFFGEMDYDTYYASLAEGLLMEPPPAATALWDNGDEGADIALWSY
```

SEQ ID NO: 355, Oryza sativa - DNA

```
ATGGACGTCGCGCGCGACATGGAGAAGAACACCACCGCCATGGGGCAATTGATGAGCTCCTCCGCG
ACGACGGCGGCGACGGCGACGGGGCCGGCGTCGCCGAAGCGGCCGGCGGGGCGGACCAAGTTCCAG
GAGACGAGGCACCCGGTGTTCCGCGGGGTGCGGCGGCGCGGGCGCGCGGGGCGGTGGGTGTGCGAG
GTGCGCGTCCCGGGCAGCCGCGGCGACCGCCTGTGGGTCGGCACGTTCGACACCGCCGAGGAGGCC
GCGCGCGCGCACGACGCCGCCATGCTCGCCCTGTGCGGGGCCTCCGCCAGCCTCAACTTCGCCGAC
TCCGCCTGGCTGCTCCACGTCCCCGCGCCCCGTCGCCTCCGGCCATGACCAGCTGCCCGACGTG
CAGCGCGCCGCCAGCGAGGCCGTCGCCGAGTTCCAGCGCCGGGGAAGTACTGCCGCCACTGCCACC
GCCACCTCCGGCGACGCCGCATCCACCGCTCCTCCGTCGTCGTCGCCCGTTCTGTCACCCAACGAC
GACAATGCCTCGTCGGCGTCCACTCCTGCGGTGGCGGCGGCGTTGGACCACGGCGACATGTTCGGT
GGCATGCGCACCGATCTGTACTTCGCGAGCTTGGCGCAGGGTCTGCTCATCGAGCCGCCGCCGCCG
CCGACCACCGCTGAGGGTTTCTGCGACGACGAAGGATGCGGCGGCGCTGAAATGGAGCTGTGGAGC
TAG
```

SEQ ID NO: 356, Oryza sativa - protein

```
MDVARDMEKNTTAMGQLMSSSATTAATATGPASPKRPAGRTKFQETRHPVFRGVRRRGRAGRWVCE
VRVPGSRGDRLWVGTFDTAEEAARAHDAAMLALCGASASLNFADSAWLLHVPRAPVASGHDQLPDV
QRAASEAVAEFQRRGSTAATATATSGDAASTAPPSSSPVLSPNDDNASSASTPAVAAALDHGDMFG
GMRTDLYFASLAQGLLIEPPPPPTTAEGFCDDEGCGGAEMELWS
```

SEQ ID NO: 357, Oryza sativa - DNA

```
ACTGCTTGAGACGTCGCACACGTCATGGAGAAGAACACCGCCGCCAGCGGGCAATTGATGACCTCC
TCCGCGGAGGCGACGCCGTCGTCGCCGAAGCGGCCGGCGGGGCGAACCAAGTTCCAGGAGACGAGG
CACCTAGTGTTCCGTGGGGTGCGATGGCGTGGGTGCGCGGGCGGTGGGTGTGCAAGGTGCGTGTC
CCGGGCAGCCGCGGTGACCGTTTCTGGATAGGCACGTCTGACACCGCCGAGGAGACCGCGCGCACG
CACGACGCCGCCATGCTCGCCTTGTGCGGGGCCTCCGCCAGCCTCAACTTCGCCGACTCTGCCTGG
CTGCTCCACGTCCCGCGCGCCCCGTCGTCTCCGGACTCCGGCCACCAGCTGCCCGATGTGCAACG
CGCTGCCTGCAAGGCCATCGCCGAGTTCCAGCGCCGGGCCGGGGAGCACCGCCACTGCCACTGCC
ACCTCCGGCGATGCTGCATCGACCGCTCCTCCGTCGGCACCCGTTCTGTCAGCCAAACAATGCGAA
```

```
TTCATCTTTCTTTCTTCACTAGATTGTTGGATGTTAATGTCAAAGCTTATCAGCAGTAGCAGAGCA
AAAGGATCGTTGTGCCTGCGAAAAAATCCCATTTCATTTTGCATGGTTACAAATTCTTACACTGCT
CTTTTGCTCGAATACATTATATTGCAGATGAATTCAATGATCGTTTTAATCCACGAATTATCAAAA
TATCAAGTCTTTCTGCTACTAACCATGATAACACACCACCTTTTTCAATGGAGGAGGTAGGCGCGG
ACGCCCTCGCCATCATCGTCGATGTCGCCACTGATGACGAGGTCCGCGCCGCTCACCAGCTCGCAC
GCCTCGTCGTCGTCCATGCTCGCCACCTCGGTCCAGCAGCTGAACC
```

SEQ ID NO: 358, Oryza sativa - protein

```
MEKNTAASGQLMTSSAEATPSSPKRPAGRTKFQETRHLVFRGVRWRGCAGRWVCKVRVPGSRGDRF
WIGTSDTAEETARTHDAAMLALCGASASLNFADSAWLLHVPRAPVVSGLRPPAARCATRCLQGHRR
VPAPGRGSTATATATSGDAASTAPPSAPVLSAKQCEFIFLSSLDCWMLMSKLISSSRAKGSLCLRK
NPISFCMVTNSYTALLLEYIILQMNSMIVLIHELSKYQVFLLLTMITHHLFQWRR
```

SEQ ID NO: 359, Oryza sativa - DNA

```
CAGAGAGAGTCATCCATGGAGGTGGAGGAGGCGGCGTACAGGACGGTGTGGTCGGAGCCGCCGAAG
AGGCCGGCGGGAAGGACCAAGTTCAGGGAGACGAGGCACCCGGTGTACCGCGGCGTGCGGCGGCGC
GGGGGGCGGCCGGGCGCGGCGGGGAGGTGGGTGTGCGAGGTGCGGGTGCCCGGGGCGCGCGGCTCC
AGGCTGTGGCTCGGCACGTTCGCCACCGCCGAGGCGGCGGCGCGCGCACGACGCCGCCGCGCTG
GCGCTCCGCGGCAGGGCCGCCTGCCTCAACTTCGCCGACTCCGCGTGGCGGATGCCGCCCGTCCCC
GCGTCCGCCGCGCTCGCCGGCGCGAGGGGGGTCAGGGACGCCGTCGCCGTGGCCGTCGAGGCGTTC
CAGCGCCAGTCGGCCGCGCCGTCGTCTCCGGCGGAGACCTTCGCCAACGATGGCGACGAAGAAGAA
GACAACAAGGACGTGTTGCCGGTGGCGGCGGCGGAGGTGTTCGACGCGGGGGCGTTCGAGCTCGAC
GACGGGTTCAGGTTCGGCGGGATGGACGCCGGGTCGTACTACGCGAGCTTGGCGCAGGGGCTGCTC
GTCGAGCCGCCGGCCGCCGGAGCGTGGTGGAGGACGGCGAGCTCGCCGGCTCCGACATGCCGCTC
TGGAGCTACTAATCAAAATCTCGCACTGAAAAGTGTGGACAAATTTTGATTCTCCAGAAATTGGGG
GAAAAAAGAGAACAGAGTATTGGTGAATTTAGAACAGAGTAGGCAATGAGACTGAGGATGAATGGC
AATTTTTGTAATTTTGGAATGTGCCAGATTTCTCCCTCCTTTTGTGATTCCATCTGATTTTGAATG
TGCAGTCAATGAATTCCTGTAAATTTACTTCTCCTCTCC
```

SEQ ID NO: 360, Oryza sativa - protein

```
MEVEEAAYRTVWSEPPKRPAGRTKFRETRHPVYRGVRRRGGRPGAAGRWVCEVRVPGARGSRLWLG
TFATAEAAARAHDAAALALRGRAACLNFADSAWRMPPVPASAALAGARGVRDAVAVAVEAFQRQSA
APSSPAETFANDGDEEEDNKDVLPVAAAEVFDAGAFELDDGFRFGGMDAGSYYASLAQGLLVEPPA
AGAWWEDGELAGSDMPLWSY
```

SEQ ID NO: 361, Oryza sativa - DNA

```
AGAATTCAAACCGGATCAACCTCGCTCGCTTACTCGTGTTTAGGCATGGACGTTTCTGCTGCGCTC
AGCAGCGACTACTCGTCGGGGACGCCGTCGCCGGTGGCGGCCGACGCCGACGACGGCTCCTCCGCC
TACATGACGGTGTCGTCGGCGCCGCCCAAGCGGCGAGCGGGGCGGACCAAGTTCAAGGAGACGCGG
CACCCCGTGTTCAAGGGCGTGCGCCGGAGGAACCCCGGGAGGTGGGTGTGCGAGGTGCGCGAGCCG
CACGGCAAGCAGCGGATATGGCTCGGGACGTTCGAGACAGCAGAGATGGCGGCGCGCGCACGAC
GTCGCCGCGCTCGCGCTCCGCGGCCGCGCCGCCTGCCTCAACTTCGCCGACTCGCCGAGGCGCCTC
CGCGTCCCGCCCATCGGCGCAAGCCACGACGACATACGGAGGGCGGCGGCTGAGGCGGCCGAGGCA
TTCCGGCCGCCACCAGATGAGAGCAATGCGGCCACCGAGGTGGCAGCCGCCGCATCGGGCGCCACT
```

FIGURE 27 (continued)

AATTCGAACGCCGAACAGTTCGCCTCCCACCCGTACTACGAGGTCATGGACGATGGGCTGGACTTG
GGGATGCAGGGCTATCTCGACATGGCGCAAGGGATGCTCATTGACCCGCCTCCAATGGCCGGTGAT
CCTGCCGTAGGTAGCGGCGAAGACGACAACGATGGCGAGGTCCAGCTATGGAGCTACTGATCCTGC
GCGTTTGAACTCAACTTGGTTTGGCGCGAAGAGATCGCATGTACAGCTTAAGGGAGTCGAGTACAA
GTACCTCAGGTGTACTCCACTCGTTGCCCCTTTCCCTTCCCTTTCGTTTTTCTTGAGCTTATCTGC
AGGGTAATGTTATGTATTGCTGCTCTTCTGATGAAATGTGATCGGAAGAAGCGGAAGGCCAGATCG
AGCTTATGGGTTCTGAAGACGGTGAAGGCTTGTCGAGTGTTGTGAGCATATATTCAGAAAGTCAGG
CACTGTGAAAGTATGAATCAGATCAGCCTTGTTACGAATGAGAGTGATCGACCTTGTTCAGTGTTT
ATAATTGAACCACTTGTGTGTAATAAGCAGCAAAGCCATGTTGCTTGCTTGATCTGACTCTTGGGA
ATGGTATATTTCTCAAAGAATGCAGGATTGACTACTCAGAATTTGACATTTTGCAGTGAAATGATA
GGATTGTTAAATTAACATTGGAGGAGAGGCATGTGTATATATGTTAAGAAACATTAGTAATGATGA
GCCTATGATACTTCGATC

SEQ ID NO: 362, Oryza sativa - DNA

MDVSAALSSDYSSGTPSPVAADADDGSSAYMTVSSAPPKRRAGRTKFKETRHPVFKGVRRRNPGRW
VCEVREPHGKQRIWLGTFETAEMAARAHDVAALALRGRAACLNFADSPRRLRVPPIGASHDDIRRA
AAEAAEAFRPPPDESNAATEVAAAASGATNSNAEQFASHPYYEVMDDGLDLGMQGYLDMAQGMLID
PPPMAGDPAVGSGEDDNDGEVQLWSY

SEQ ID NO: 363, Oryza sativa - DNA

CCAGCAGCAGCAACACACACTACTGACATGGAGTACTACGAGCAGGAGGAGTACGCGACGGTGACG
TCGGCGCCGCCGAAGCGGCCGGCGGGGAGGACCAAGTTCAGGGAGACGAGGCACCCGGTGTACCGC
GGCGTGCGGCGGCGGGGGCCCGCGGGGCGGTGGGTGTGCGAGGTCAGGGAGCCCAACAAGAAGTCC
CGCATCTGGCTCGGCACCTTCGCCACCGCCGAGGCCGCCGCGCGCGCCCACGACGTCGCCGCGCTC
GCCCTCCGCGGCCGCGGCGCGTGCCTCAACTTCGCCGACTCGGCCCGCCTCCTCCGCGTCGACCCG
GCCACCCTCGCCACCCCCGACGACATCCGCCGCGCCGCCATCGAGCTCGCCGAGTCATGCCCGCAC
GACGCCGCCGCCGCCGCCTCCAGCTCCGCCGCCGCCGTCGAGGCCTCCGCCGCCGCCGCGCCC
GCCATGATGATGCAGTACCAGGACGACATGGCGGCGACGCCGTCCAGCTACGACTACGCGTACTAC
GGCAACATGGACTTCGACCAGCCGTCCTACTACTACGACGGGATGGGCGGCGGCGGCGAGTACCAG
AGCTGGCAGATGGACGGCGACGACGATGGTGGCGCCGGCGGCTACGGCGGCGGCGACGTCACACTC
TGGAGCTACTGATGATCGCGAGTTGGAGCTAGCAGTTTTGAGCTCAACCAGCTTTGCTCCTCCTAT
ACAGCTAAATACTGTAGGAGAAATTAATGGAGATTTTT

SEQ ID NO: 364, Oryza sativa - protein

MEYYEQEEYATVTSAPPKRPAGRTKFRETRHPVYRGVRRRGPAGRWVCEVREPNKKSRIWLGTFAT
AEAAARAHDVAALALRGRGACLNFADSARLLRVDPATLATPDDIRRAAIELAESCPHDAAAAAASS
SAAAVEASAAAAPAMMMQYQDDMAATPSSYDYAYYGNMDFDQPSYYYDGMGGGGEYQSWQMDGDDD
GGAGGYGGGDVTLWSY

SEQ ID NO: 365, Oryza sativa - DNA

CATCCATGGAGGTGGAGGAGGCGGCGTACAGGACGGTGTGGTCGGAGCCGCCGAAGAGGCCGGCGG
GAAGGACCAAGTTCAGGGAGACGAGGCACCCGGTGTACCGCGGCGTGCGGCGGCGCGGGGGCGGC
CGGGCGCGGCGGGGAGGTGGGTGTGCGAGGTGCGGGTGCCGGGGCGCGCGGCTCCAGGCTGTGGC
TCGGCACGTTCGCCACCGCCGAGGCGGCGGCGCGCGCACGACGCCGCCGCGCTGGCGCTCCGCG

FIGURE 27 (continued)

```
GCAGGGCCGCCTGCCTCAACTTCGCCGACTCCGCGTGGCGGATGCCGCCCGTCCCCGCGTCCGCCG
CGCTCGCCGGCGCGAGGGGGGTCAGGGACGCCGTCGCCGTGGCCGTCGAGGCGTTCCAGCGCCAGT
CGGCCGCGCCGTCGTCTCCGGCGGAGACCTTCGCCGACGATGGCGACGAAGAAGAAGACAACAAGG
ACGTGTTGCCGGTGGCGGCGGCGGAGGTGTTCGACGCGGGGGCGTTCGAGCTCGACGACGGGTTCA
GGTTCGGCGGGATGGACGCCGGGTCGTACTACGCGAGCTTGGCGCAGGGGCTGCTCGTCGAGCCGC
CGGCCGCCGGAGCGTGGTGGGAGGACGGCGAGCTCGCCGGCTCCGATATGCCGCTCTGGAGCTACT
AATCAAAATCTCGCACTGAAAAGTGTGGACAAATTTTGATTCTCCAGAAATTGGGGGAAAAAAGAG
AACAGAGTATTGGTGAATTTAGAACAGAGTAGGCAATGAGACTGAGGATGAATGGCATTTTTGTAA
TTTTGGAATGTGCCAGATTTCTCCCTCCTTTTGTGATTCCATCTGATTTTGAATGTGCAGTCATGA
ATTC
```

SEQ ID NO: 366, Oryza sativa - protein

```
MEVEEAAYRTVWSEPPKRPAGRTKFRETRHPVYRGVRRRGGRPGAAGRWVCEVRVPGARGSRLWLG
TFATAEAAARAHDAAALALRGRAACLNFADSAWRMPPVPASAALAGARGVRDAVAVAVEAFQRQSA
APSSPAETFADDGDEEEDNKDVLPVAAAEVFDAGAFELDDGFRFGGMDAGSYYASLAQGLLVEPPA
AGAWWEDGELAGSDMPLWSY
```

SEQ ID NO: 367, Zea mays - DNA

```
ATGGAGTACGCCGCCGTCGGCTACGGCTACGGGTACGGGTACGACGAGCGCCAGGAGCCGGCGGAG
TCCGCGGACGGCGGCGGCGGCGGCGACGACGAGTACGCGACGGTGCTGTCGGCGCCACCCAAGCGG
CCGGCGGGGCGGACCAAGTTCCGGGAGACGCGGCACCCCGTGTACCGCGGCGTGCGGCGGCGCGGG
CCCGCGGGGCGCTGGGTGTGCGAGGTCCGCGAGCCCAACAAGAAGTCGCGCATCTGGCTCGGCACC
TTCGCCACCCCCGAGGCCGCCGCGCGCGCGCACGACGTGGCCGCGCTGGCCCTGCGGGGCCGCGCC
GCGTGCCTCAACTTCGCCGACTCGGCGCGCCTGCTCCAGGTCGACCCCGCCACGCTCGCCACCCCC
GACGACATCCGCCGCGCCGCCATCCAGCTCGCCGACGCCGCCTCGCAGCAGGATGAGACTGCCGCC
GTTGCCGCTGACGTGGTCGCGCCCTCGCAGGCGGACGACGTCGCCGCCGCCGCCGCCGCCGCGGCG
GCGATGTACGGCGGCGGCATGGAGTTCGACCACTCGTATTGCTACGACGACGGGATGGTGAGCGGG
AGCAGCGACTGCTGGCAAAGCGGCGCCGGCGCCGGTGGATGGCATAGCATCGTGGACGGCGACTAC
GACGACGGCGCCAGCGACATGACGCTCTGGAGCTACTGA
```

SEQ ID NO: 368, Zea mays - protein

```
MEYAAVGYGYGYGYDERQEPAESADGGGGGDDEYATVLSAPPKRPAGRTKFRETRHPVYRGVRRRG
PAGRWVCEVREPNKKSRIWLGTFATPEAAARAHDVAALALRGRAACLNFADSARLLQVDPATLATP
DDIRRAAIQLADAASQQDETAAVAADVVAPSQADDVAAAAAAAAMYGGGMEFDHSYCYDDGMVSG
SSDCWQSGAGAGGWHSIVDGDYDDGASDMTLWSY
```

SEQ ID NO: 369, Zea mays - DNA

```
ATGTGCCCAACCAAGAAGGGGATGACCGGAGAGCCGAGCTCGCCATGCAGCTCGGCATCAGCCTCG
ACCTTACCGGAGCACCACCAGACGGTGTGGACGTCGCCGCCGAAGCGGCCAGCGGGCGGACCAAG
TTCCGGGAGACGCGGCACCCGGTGTTCCGCGGCGTCCGGCGCCGGGGCAGCGCCGGCGGTGGGTG
TGCGAGGTGCGCGTGCCGGGGAGGCGCGGCTGCAGGCTCTGGCTCGGCACCTTCGACACGGCCGAG
GCGGCGGCCCGCGCGCACGACGCCGCCATGCTCGCCCTCGCCGGCGCGGGCGCCTGCTGCCTCAAC
TTCGCCGACTCGGCCTGGCTCCTCGCGGTCCCGGCCTCGTGCGCCAGCCTCGCCGAGGTCCGCCAC
GCGGTCGCGGACGCCGTGGAGGACTTCCTCCGCCATCAGGTGGTCCCGGAGGACGACGCCCTCGCG
```

FIGURE 27 (continued)

```
GCCACGCCGTCGTCGCCTTCCAGCGAAGACGGCAGCACCTCTGATGGCGGGGAGTCCTCCTCTGAT
TCCTCTCCGCCCACCGGGGCCTCGCCGTTCGAATTGGATGTGTTCAACGACATGAGCTGGGACCTG
CACTACGCGAGCTTGGCGCAGGGATTGCTCGTGGAGCCACCGTCCGCGGTCACGGCGCTCATGGAC
GAAGGCTTCGCCGATGTGCCGCTCTGGAGCTACTAG
```

SEQ ID NO: 370, Zea mays - protein

```
MCPTKKGMTGEPSSPCSSASASTLPEHHQTVWTSPPKRPAGRTKFRETRHPVFRGVRRRGSAGRWV
CEVRVPGRRGCRLWLGTFDTAEAAARAHDAAMLALAGAGACCLNFADSAWLLAVPASCASLAEVRH
AVADAVEDFLRHQVVPEDDALAATPSSPSSEDGSTSDGGESSSDSSPPTGASPFELDVFNDMSWDL
HYASLAQGLLVEPPSAVTALMDEGFADVPLWSY
```

SEQ ID NO: 371, Zea mays - DNA

```
GCTCAAGCTCGAGACAAGAAACCAGAACCAGCTCACTCCTCACTCCACTTCCACTCCCAACAGCAA
GCTCAAGCAGTCAGTCACCGGCAGGGGTCAGGGTCACAGTCACAGCAGCAGCCATGGACACGGCCG
GCCTCGTCCAGCACGCGACCTCCTCGTCTTCCACCTCCACCTCGGCGTCGTCGTCCTCGTCCGAGC
AGCAGAGCCGCAAGGCGGCGTGGCCGCCGTCGACCGCTTCCTCACCACAGCAGCCGCCCAAGAAGC
GCCCCGCGGGGCGCACAAAGTTCCGGGAGACGCGGCACCCGGTGTTCCGCGGCGTGCGGCGGCGGG
GCGCCGCGGGCCGGTGGGTGTGCGAGGTGCGCGTCCCGGGGAGGCGCGGCGCGCGGCTGTGGCTCG
GCACCTACCTCGCCGCCGAGGCGGCGGCGCGCGCACGACGCCGCGATACTCGCCCTGCAGGGCC
GCGGCGCGGGGCGCCTCAACTTCCCGGACTCCGCGCGGCTGCTCGCCGTGCCGCCCCGTCCGCGC
TCCCGGGCCTGGACGACGCCCGCCGCGCGGCGCTCGAGGCCGTCGCGGAGTTCCAGCGCCGCTCTG
GGTCCGGGTCCGGGGCCGCCGACGAAGCGACCTCGGGCGCGTCTCCTCCCTCCTCGTCGCCGTCGC
TGCCGGACGTTTCTGCGGCTGGCTCGCCGGCGGCGGCGCTTGAGCACGTGCCTGTGAAGGCCGACG
AAGCAGTGGCGTTGGACTTGGACGGCGACGTGTTCGGGCCCGACTGGTTCGGGGACATGGGCCTGG
AGTTGGATGCGTACTACGCCAGCCTCGCGGAAGGGTTGCTCGTGGAGCCGCCGCCGCCGCCGGCGG
CCTGGGATCATGGAGACTGCTGTGACTCCGGAGCTGCGGACGTCGCGCTCTGGAGCTACTACTAGC
AAAGTTAACAATAATAAGCTTGACAGCCAACCCCAAAAGCCCCCCAACTGATTGTATTCACCTCTG
TAACAAAATTCAAATTGATTTCCCAGCAAATGAACTTCAAAAGAAGTCTTTGGTTCCGATTTAAAA
AAAAAAAAAAAAAAAAAAAAAAAAAAAAAA
```

SEQ ID NO: 372, Zea mays - protein

```
MDTAGLVQHATSSSSTSTSASSSSSEQQSRKAAWPPSTASSPQQPPKKRPAGRTKFRETRHPVFRG
VRRRGAAGRWVCEVRVPGRRGARLWLGTYLAAEAAARAHDAAILALQGRGAGRLNFPDSARLLAVP
PPSALPGLDDARRAALEAVAEFQRRSGSGSGAADEATSGASPPSSSPSLPDVSAAGSPAAALEHVP
VKADEAVALDLDGDVFGPDWFGDMGLELDAYYASLAEGLLVEPPPPPAAWDHGDCCDSGAADVALW
SYY
```

SEQ ID NO: 373, Zea mays - DNA

```
ATGGCTCAAGAGCTCCACGAAACGTCCTCTTGCTCTGCCACCACCACCTCGTCGTGCACCACATCC
TGCTGCTCGTCCACTGTCACAGACTCGTCCTCTTCGCCCCCGTCACCGGCGGCGGCCAATGCCGCG
CCCGCGACACGGAAGCGGCAGGCGTTGGAGGCCGAGGCCGAGGCCGAGGCGGGCGGTGAGGAGGAG
GAGGAGGAGGAGGGAAGCTGTGCTGGTAATAAAGCGGCGCCGGCCAAGAAGCGACCGCGGGGCAGC
GAGGGGAAACACCCGACGTTCCGCGGCGTGCGGATGCGGGCGTGGGCAAGTGGGTGTCGGAGATC
CGCGAGCCGCGCAAGAAGTCGCGCATATGGCTCGGCACGTTCCCCACCGCCGAGATGGCCGCGCGC
```

```
GCCCACGACGTCGCGGCGCTCGCCATCAAAGGCCGCGCCGCGCACCTCAACTTCCCGGACTTCGCC
GGCGCGCTCCCGCGCGCCGCGTCCGCGGCGCCCAAGGACGTCCAGGCAGCCGCCGCATTGGCCGCT
GCGTTCACGTCGCCGTCATCGGAGCCCGGCGCCGGCGCGCACGAGGAGCCCGCTGCCAAGGACGGC
GCCGCGCCCGAGGAGGCAGCCGCCGACGCACAGGCACCAGTACCAGTAGCACTACCACCGCCGGCG
GCCTCTCGGCCAGGGACGCCGTCGAGCGGCGTGGAGGACGAGCGGCAGCTGTTCGACCTGCCGGAC
CTGCTCCTCGACATCCGGGACGGGTTCGGGCGCTTCCCGCCGATGTGGGCCCCGCTCACTGACGTG
GAGGAGGTGGTCAATGCGGAGCTGCGCCTCGAGGAGCCGCTGCTTTGGGAGTAG
```

SEQ ID NO: 374, Zea mays - protein

```
MAQELHETSSCSATTTSSCTTSCCSSTVTDSSSSPPSPAAANAAPATRKRQALEAEAEAEAGGEEE
EEEEGSCAGNKAAPAKKRPRGSEGKHPTFRGVRMRAWGKWVSEIREPRKKSRIWLGTFPTAEMAAR
AHDVAALAIKGRAAHLNFPDFAGALPRAASAAPKDVQAAAALAAAFTSPSSEPGAGAHEEPAAKDG
AAPEEAAADAQAPVPVALPPPAASRPGTPSSGVEDERQLFDLPDLLLDIRDGFGRFPPMWAPLTDV
EEVVNAELRLEEPLLWE
```

SEQ ID NO: 375, Zea mays - DNA

```
CACTCAGACTCAGCTCAATCCCGAGACAAAGGAACCCACCTCCACTCCCACCAGCAAGCTCAAGCA
AGCAGCCACCACCAGCAGCGATCAGCGGCAGCCATGGACATGGGCCGGCACCAGCTCCAGCTCCAG
CACGCGGCCTCCTCGTCCTCCACCTCGGCGTCGTCCTCGTCCGAGCAGGACAAGCCGCTCTGCTGC
TCTGGTCCCAAGAAGCGCCCCGCGGGGCGCACCAAGTTCCGGGAGACGCGGCACCCGGTGTTCCGC
GGCGTGCGGCGGCGGGGCGCCGCGGGGCGGTGGGTGTGCGAGGTGCGCGTCCCCGGGCGGCGCGGC
GCGCGGCTGTGGCTCGGCACCTACCTCGGCGCCGAGGCGGCGGCGCGCGCACGACGCCGCGATG
CTCGCCCTGGGCCGCGGCGCGGCCTGCCTCAACTTCCCCGACTCCGCGTGGCTGCTCGCCGTGCCG
CCCCCGCCCGCGCTCTCGGGCGGCCTGGACGGCGCCCGCCGGGCCGCGCTCGAGGCCGTCGCGGAG
TTCCAGAGACGCCGCTTCGGGGCGGCAGCCGCCGACGAAGCGACCTCGGGCACGTCTCCTCCCTCC
TCCTCCTCCTCGGCGACGAAGCCGGCGCCGGCGATTGAGCGCGTGCCTGTGGAGGCCAGTGAGACG
GTGGCGTTGGACGGCGCCGTGTTCGAGCCCGACTGGTTCGGGGACATGGACTTGGACTTGTACTAT
GCCAGCCTCGCGGAAGGGCTGCTCGTGGAGCCGCCGCCCCCGCCCCCGCCCGCCGCCTGGGATCAT
GGTGACTGCTGCGACTCCGGAGCTGACGTCGCGCTCTGGAGCTACTAGCAAGCTATAGCAGCAATA
AGCTCCACCAACTCATCTGTACTGTAGTGTACTTGTACCTTGTACCTTGTACCAAAATCCAAATTG
ATTTGTAGCGAATTAACTTACCAATCCCCCTTGGCAAAAAAAAACCGAGGTCGATGATGAGGATGG
CGGTAGTGACGAGGATAACGACGACGACGAGTAAATAGTATTTCCGCTGTTGTGAGGTAGCAAATC
GATTGTTAGGTCCCCAATTAGCTCACTGGTTTGCTATCTTTAATGTTAAGTTGTTTGGAACAGGTG
TTTATGAAGGGGATCTATTAGTTTCGTGAGGTTGTTAGTTTAGTGCATTAGCAAAGAAAAAGCCGA
ATGCTGCTAGCTATTATGTTGCTTTTCTTTTGCTAATCACTTGTGTCACAACTTTCTGTACCTGTT
TCATTGACTAATCTAGTGACTAGTCAGTTATGGGTTTAATGTTTGGTTTTGGTTTTATATATTTCT
TTGTTGCATTCTGTGCGGTCTACGGAAGTCATCTGTGCTGTATGAATGATGAATATCTGCTTGTGG
CTCGTTTCAGTTTAGTGAGTTTTTGTTTTGTGACTCAGGTTAATTTACATGAGTTTGTTTGTGACT
GTT
```

SEQ ID NO: 376, Zea mays - protein

```
MDMGRHQLQLQHAASSSSTSASSSSEQDKPLCCSGPKKRPAGRTKFRETRHPVFRGVRRRGAAGRW
VCEVRVPGRRGARLWLGTYLGAEAAARAHDAAMLALGRGAACLNFPDSAWLLAVPPPPALSGGLDG
ARRAALEAVAEFQRRRFGAAAADEATSGTSPPSSSSATKPAPAIERVPVEASETVALDGAVFEPD
WFGDMDLDLYYASLAEGLLVEPPPPPPPAAWDHGDCCDSGADVALWSY
```

FIGURE 27 (continued)

SEQ ID NO: 377, Triticum aestivum - DNA

TTTTTGACGCTGCAACTGATGGACACCGCCGCTGCCGGCTCCCCGCGTGAGGGGCACAGGACGGTG
TGCTCGGAGCCGCCCAAGAGGCCGGCAGGGCGGACCAAGTTCAGGGAGACGCGCCACCCGCTGTAC
CGCGGCGTGCGGCGCCGGGGCCGGCTCGGGCAGTGGGTGTGCGAGGTTCGCGTGCGCGGCGCGCAA
GGGTACAGGCTCTGGCTCGGCACCTTCACCACTGCCGAGATGGCGGCGCGCGCACGACTCCGCC
GTGCTCGCGCTCCTCGACCGCGCCGCCTGCCTCAACTTCGCCGACTCCGCCTGGCGGATGCTGCCC
GTCCTCGCGGCTGGCTCGTCCCGCTTCAGCAGCGCGCGGGAGATCAAGGACGCCGTCGCCATCGCC
GTCCTGGAGTTCCAGCGGCAGCGCCCCGTCGTGTCAACGTCGGAGATGCACGACGGCGAAAAGGAC
GCCCAAGGCTCGCCGACGCCGAGCGAGCTGTCCACGTCCAGCGACTTGTTGGACGAGCACTGGTTT
GGCGGCATGGACGCCGGCTCGTACTACGCGAGCTTGGCGCAGGGGATGCTCATGGAGCCGCCGTCC
GCCAGAACGTGGAGCGAGGATGGCGGCGAATACAGCGCCGTCTACACGCCGCTTTGGAACTAATTA
TCCGACTAATTAAGCCATGTACAGTTTTGGAAACTACTCCCTCGGTAAACTAATATAAGAGCATTT
AAATCATTAAAATAGTGATCTAAACACTCTTATATTAAGTTTACGGAGGGAGTAGGCTACTAGTGG
TTGTGTTG

SEQ ID NO: 378, Triticum aestivum - protein

MDTAAAGSPREGHRTVCSEPPKRPAGRTKFRETRHPLYRGVRRRGRLGQWVCEVRVRGAQGYRLWL
GTFTTAEMAARAHDSAVLALLDRAACLNFADSAWRMLPVLAAGSSRFSSAREIKDAVAIAVLEFQR
QRPVVSTSEMHDGEKDAQGSPTPSELSTSSDLLDEHWFGGMDAGSYYASLAQGMLMEPPSARTWSE
DGGEYSAVYTPLWN

SEQ ID NO: 379, Triticum aestivum - DNA

CCACCTCGTTACACCACAAACCACTCTCAACGCCAGCTGCGACCGATGGACACCAACGCCGCCTGG
CCGCAGTTTGACGGGCAAGAGTACAGGACGGTGTGGCCGGAGGAGCAGGAGTACCGGACGGTGTGG
TCGGAGCCGCCGAAGCGGCGGGCGGGGCGGAACAAGTTGCAGGAGACACGCCACCCAGTGTACCGC
GGCGTGCGCCGCCGTGGCCGGGAAGGGCAGTGGGTGTGCGAGCTGCGCGTGCCGGCCGGAAGCCGG
AGTTACTCCAGGATCTGGCTTGGCACCTTCGCCAGTGCCCAGATGGCGGCGCGCGCACGACTCG
GCCGCGCTCGCGCTCTCCGGCCGCGACGCGTGCCTCAACTTCGCCGACTCCGCCTGGCGGATGATG
CCCGTCCACGCAGCCGGGTCGTTCAAGTTGGCCGCCGCGCAGGAGATCAAGGACGCCGTCGCCGTG
GCCCTCAAGGAGTTCCAGGAGCAGCAGCGCCCTGCCGACGAGTCAACGGCGCCGTCGTCCACGGCC
GAGGAGAGCGCGCTCTCCATCATCCCCAGCGACCTGTCGGGGCTCGACAATGAGCACTGGATCGGC
GGCATGGAGGCCGGGTCGTACTACGCGAGCTTGGCGCAGGGGATGCTCATGGAGCCGCCGGCCGAC
GGAGCTTGGCAGGAGGACCGCGAACACGACGACGGATTCGACACGTCGCTGTGGAGCTACTAGTGT
GATCAACTGATTAAGCAATGTAAAGATCTAGAGAGTACTGCTAGTGCTAGATTGTGTTTCACCAAA
TATGGGAAGAAGAGAGTAAGCATCGGGGAAAGGTTTCCCCCAATGTGAAAGCGCTCGGTTTC
TACTCCCGGAAGGGCACAAATGAGCTTCTTTCTTTATTTAATAAATAAATAGAGAAATGAGCAGCA
AAAAAAAAAAAAAAAAAAAAA

SEQ ID NO: 380, Triticum aestivum - protein

MDTNAAWPQFDGQEYRTVWPEEQEYRTVWSEPPKRRAGRNKLQETRHPVYRGVRRRGREGQWVCEL
RVPAGSRSYSRIWLGTFASAQMAARAHDSAALALSGRDACLNFADSAWRMMPVHAAGSFKLAAAQE
IKDAVAVALKEFQEQQRPADESTAPSSTAEESALSIIPSDLSGLDNEHWIGGMEAGSYYASLAQGM
LMEPPADGAWQEDREHDDGFDTSLWSY

FIGURE 27 (continued)

SEQ ID NO: 381, Triticum monococcum - DNA

AAGCTTCAAGAATTAGTTATTTTTACATATAGACCGTGTATTGAAGATGTTCTAAGTGGTGCTCCT
TTGTGCCTTCCGTCCCCCTAGTACTCGGGGAACCAGACGACCCCATGCAGCAGTGACTGCTGCCTT
CTCTTTGCAGCCGAACAGCCGGCGGACCAATCAGTCAAGGCAATCACCGCTGCATTAAGCCAGCAC
GAAGCTGCCTTTTTTTGCTTAACACTGCGAAGCCAAAAGCCCCCACACGCCCACCAGGAGAGAAGT
CACACGACGCTATCACCCCACAGTCCCTTTGTCACCAGCTGTCCGGACACCGCATCCCTCCCGCCG
TCCCAAGCGCGTTCATACACTTGAACCTCCAGCATCACGCATACCTATATATAAGGAAGTATCCCA
CACTCTCGCTCAAGCTCAACAAGCTAGCTCACACTCCTCAGTCCTCCGTAAGCTCAAGCAGCAAGC
TCGACTGCTCAAGCAGGAATCCACCAGCCAATCACCCAGCACTCAGCCGGCAGCCATGGACATGGG
CCTTGAGGTCTCGAGCTCCTCCCCGTCCTCCTCGTCGGCGTCGTCCTCGCCCGAGCACGCGGCGGG
GCGGGCGTCGCTGGCCAAGCGCCCCGCGGGGCGCACCAAGTTCCGGGAGACGCGGCACCCGGTGTA
CCGCGGCGTGCGGCGCCGGGGCAACGCCGAGCGGTGGGTCTGCGAGGTGCGCGTCCCCGGCAAGCG
CGGCGCGAGGCTCTGGCTCGGGACGTACGCCACGGCCGAGATCGCGGCGCGCGCCAACGACGCCGC
CATGCTCGCCCTGGGCGGCCGCTCCGCCGCGTGCCTCAACTTCGCGGACTCCGCGTGGCTGCTCGC
CGTGCCGCCCGCACTCGCCGACCTCGGCGACGTCCGGCGCGCGGCGGTCGAGGCCGTCGCTGATTT
CCAGAGACGAGAGGCTGCCAACGGCTCCCTCACAGTCACCGCCACCGTCACCGAAGAGGCCTCCTG
TGGCGCTCCTGAAGAATCGTCGTCTGAGTCTGACAGTGTCGGTTCGTCGGAGACGTCGGAACCTTC
TGCCGATGGAGAGTTCGAGGTGCCGGTCGCGGTGGACACCGATATGTTCAGGCTTGACTTGTTCCC
GGAACTGGATCTGTGCTCGTACTACGCGAGCCTCGCGGAGGCGCTGCTCGTGGACCCGCCGGCACC
GGTGACCACCACCTACGCGTACTGGGACAACGGCGACGGCGGAGCTGATGTCGCGCTCTGGAGCTA
CTAGCTAGTACAGTCGATAATTCCCCTCGCAAAAAAAAGTAGTGCCGATAATTCCCAGCTCTGTA
GCTATTTTTCCCCTGTTACAAAGTTTTCCCCTTGTGGGAAAAGACTATGTACGTAGTACTCCTAAC
TAATAAGGTGAAGCTGCTCCTAATTCAATACTCCCTCTATCCGAAAATACTTGTCATCAAAATAAA
TAAATAAAAATGTATCTAAATGTATTTTAGTTTTAAATATATTTTTTTTGTTCATTTTAATGACAA
GTATTTTCGGACGGAGAGAGTACTTAACTGTGAAACGGGTTTACTCGTATAAAATCTTTTGCCACT
GATAGGTCACTATTCCCACGCCGGCCCTTGACTCCCTGAAATGTACATACATGTAGTTTCAAACAA
TAAAAAGGAGCACAAAAACGGCAACTCACAGCAGATACTTTGTTTTTTTGACAGAAAAGTTTATTT
TATTAATCAAAGGATAGCAACATCGTTTGCCAACAGGTTTACAATGAAATTGCGGGTCATCAACCC
AGCGAGATGGATTATTAGCATGACCCCAACATGCTAACTCATGAGCTACATTATTTAACTCTCTAA
TACAATGCTCAATAGTTTTTTTAAAAAAGGAGGATGATCCCCGGCCTCTGCATCTGTGAGATGCAT
ACGACCACTTTATTGATTATTTTCAAGGACCTTATAAAGCGTTACAACAATAAGCTT

SEQ ID NO: 382, Triticum monococcum - protein

MDMGLEVSSSSPSSSSASSSPEHAAGRASLAKRPAGRTKFRETRHPVYRGVRRRGNAERWVCEVRV
PGKRGARLWLGTYATAEIAARANDAAMLALGGRSAACLNFADSAWLLAVPPALADLGDVRRAAVEA
VADFQRREAANGSLTVTATVTEEASCGAPEESSSESDSVGSSETSEPSADGEFEVPVAVDTDMFRL
DLFPELDLCSYYASLAEALLVDPPAPVTTTYAYWDNGDGGADVALWSY

SEQ ID NO: 383, Triticum monococcum - DNA

TTAGCTCCACAACGGCGTCTGCGTCTCCGCCACGCCGCTGTGCTCGCTGTCCTCTCGCCAGGCTCC
GGCGTCCGGCGGCTCCACGAGCATCCCTGCGCCAAGCTCTCGTAGTACGACCCGGCAACCATGCC
GCCAAACCACTGCTCGTCGTCGAGCTCCAGCAAGTCGCCTGACGACATGGAGAACAGCGCGCCGCT
CGGGGCGACGGCCGGCTCCGCTGCCGGGCACGCGACTGGAAGAACGATCTGCTGCCGCTGGAACGC
GAGGACGGCGACGGCGACGGCGGTCTTGATCTCCCGCGCGCTGCCGAAGCCGAAGGAGCCGGCCGC
GAGCACGGGCAGCATCCGCCAGGCGGAGTCGGCGAAGTTGAGGCAGGCTTTGCGGCCGGAGAGCGC

FIGURE 27 (continued)

GAGCACGGCGGCGTCGTGGGCGCGCGCCGCCATCTCGGCGGTGACGAAGGTGCCGAGCCAGAGCCT
GGATCCCCTCATCCCGAGCACGCGCACCTCGCAGACCCACCGCCCGGCGGGCCCCGCTGGCGCAC
GCCGCGGTACAGCGGGTGGCGCGTCTCCTGGAACTTGGTCCGCCCCGCGGGCCGCTTCGGCGGCTC
CGACCTCACCGTCCTGTGCCGCTGCTCCTCCTGACCAGACGGCAT

SEQ ID NO: 384, Triticum monococcum - protein

MPSGQEEQRHRTVRSEPPKRPAGRTKFQETRHPLYRGVRQRGPAGRWVCEVRVLGMRGSRLWLGTF
VTAEMAARAHDAAVLALSGRKACLNFADSAWRMLPVLAAGSFGFGSAREIKTAVAVAVLAFQRQQI
VLPVACPAAEPAVAPSGALFSMSSGDLLELDDEQWFGGMVAGSYYESLAQGMLVEPPDAGAWREDS
EHSGVAETQTPLWS

SEQ ID NO: 385, Triticum monococcum - DNA

AAGCTTCAGCATGAATGGCGAAAATGCACGTGAAGAAGCTCCGATCGGTAGGACGTAACAGACGGG
CACAAATGGACAAAGAGTGCTCGACCAACCTATAAACAAACAATAGGCGAAAAAACCACGTATCTG
TTTGTGTCGGCGCGTCGGAGTGCTCTAACCTCTATGCAACAAAGAGTCGCCGCGTTAAGGCGGGCG
GGCGGGCGGCAGGCACATGGCGTCCCGCCTCGGCACCTCGTGTCAGCCCGGCAGCCCCGCCACGTA
CCAAAGAGCACGCAAAGGGCAAGGTTAACCTGACGTGCGCCGCGCCACGCCGGGGATCGTCGTTA
TCGCCGCCCGGCGTGGGCGCGCAGACGCGCAGTCAGTTGACAGGCCGAAGCACCGTCCGTCCCACG
CAGGCACGCAGCTGCTCTGCGGGACAGAGTACCAGTACTAGGATAATAACGGCGGGCCGTGGACGC
GTTCGGGCGGGCGGCGCCAGGGCACGAGCCGCCGCCCATCCGTCCCTGCCGCACGTGCTTTCCTCG
AGATCCGGAGCTCTACCAGTACACCATAGTCTGACCCACTGACACAGTACGATGCCGGCCGGCCAA
GACCAGCAGAAAATCCCGTCTCTGTCGCCGTCTCCACGTGGCCTCTCCCCCTTCCGGTCGCCTTGC
TTCCGATGCAAAGTGTGCAATTCCGAACTCTTCTAGTTGTAGCCTTGTATACTCCGCGCGAAGCTA
GCCCGCCACGCCAACGCAGCCGGCCTCCCTCCGCCACCGTGTCCCGCGACGCGCCGCCCATTCGGA
CCCGCCACGCGCCCCGGCCGAATCCTATATACACACGTCGCTCTCCTCGCTCCCTCCCTCCCGATC
ATACAAACCTCGATCACAAGCCAACACCATTGATTCGCTAGCTACAGTGTCTGCAGATAAGCAAAC
GATCGATCCGTGCAAGATGGACAACTCCGGCGTGGTCTTCTATGGCGGCGCATACGCGACGGTGAT
GTCGGCGCCGCCGAAGCGGCCGGCGGGGCGGACCAAGTTCCGGGAGACGCGCCACCCGGTGTACCG
CGGCGTGCGCCGGCGCGGCGCCGCGGGGCGCTGGGTGTGCGAGGTGCGCCAGCCCAACAACAAGTC
CCGCATCTGGCTCGGCACCTTCGCCAGCCCCGAGGCCGCCGCGCGCGCCCACGACGTCGCCGCGCT
CGCGCTCCGGGGCCGCGCCGCCTGCCTCAACTTCGCCGACTCGGCCGCGCTGCTCGCCGTCGACCC
GGCCACGCTCCGCACGCCCCAGGACATCAGAGCCGCCGCAATCACGCTCGCCCAGACGGCCTGCCC
GCACGACGCGCCGAGGTCCTCTGTGTCCGCGGCGTCTGCGCCGGCGCCCGCGATGGTGATCACGCA
GGAGGCCGCGGCTGCGCCGTACGACAGCTACGCCATGTACGGCGGCTTGGCGGACCTGGAACAGCA
TTCCCACTGCTACTACGACGGGATGAGCGGCAGCGGCGACTGGCAGAGCATCTCACACATGAACGT
CGCCGACGAAGACGGTGGCTACGGCGCAGGAGACGTCGCGCTCTGGAGCTACTGATCGAGTGGGAT
TGATCTGGCAGTTTGTTGAGCACGATTCGTTTGCTCCTGAGTCCTCCGAAATCCACGATCGATAGG
GGAGTGGCGTATGGACGCACACCATATTCGCATGAGCTAGTTTCAAGCACGCGTACTCTGCTTTCC
CATGTTCTTGAAAATTGGCGCTAAAACTACACACGTGAGCTAGTTTTGGTAGGGGTATAGTGCTAG
GAAATATATGCAGCCAGTTTGCTGAGCGGTTACAGACAATTTATACCTCACTCGAGATTTTTTTTT
CCCTTCCATGTAAATAGCTCTGTCAAAAGTAATATACTCTACCTTGTAAATACTGCAGATCCTTAA
TTTGATCTTTTTTTCTCTTTAAAATGATGAGAGCAATTATAAAGATTCACCAAAGCAAAGCACCTCA
AACATAATAAAAGATACATCGAGATCCATGAACAATCAAACCACCGCCGCCGCCGTCAAAACAAGC
CATTGAATCCTTTATTTGATCTGAGGAATCTGACACGAAATCTCGTCGTTGCGGGTGCCCTGACCT
CGCCGCCCAAGAAGCTGGCAGAATATGCCCAAGCTT

FIGURE 27 (continued)

SEQ ID NO: 386, Triticum monococcum - protein

MDNSGVVFYGGAYATVMSAPPKRPAGRTKFRETRHPVYRGVRRRGAAGRWVCEVRQPNNKSRIWLG
TFASPEAAARAHDVAALALRGRAACLNFADSAALLAVDPATLRTPQDIRAAAITLAQTACPHDAPR
SSVSAASAPAPAMVITQEAAAAPYDSYAMYGGLADLEQHSHCYYDGMSGSGDWQSISHMNVADEDG
GYGAGDVALWSY

SEQ ID NO: 387, Gossypium hirsutum - DNA

TCTACCTACTACGCATACATACATGCACGCAAATGTAGAATCACAGATATGGCCAATTTGTCCCCC
GAAGTGAACCCACCAACCCCTCAAATCCCCGACTCTACGCTCGATCTTGTGCAGTTGCCAAATCAC
AGCAACCTACCTTCCATCCCGACGCCAAACCCTGTTCAATATAGCTGGCCTGGTTCCGGAAGGCAT
TCTAGTTATCGGGGAATACGAAGCAGGAGCGGCAAATGGGTATCTGAAATACGCGAGCCGCGTAAA
ACCACGCGTATATGGCTCGGAACGTACCCCACTCCTGAAATGGCAGCCACCGCGTATGATGTGGCT
GCTATTGCTCTAAAAGGTCCCGACACGGATTTGAACTTTCCGGATATGATTCTTTCGTATCCAAAA
GTGGCTTCTACATCCGCAGCCGATATTCGAGCGGCTGCTGCTAGTGCTGCCGCTTCCAGGCTACCC
ATGCCAGATACGGGGTCATCAAAACAGGATCAAGGCAACCTTCAAAATGAGGGTACCGCGTCGACG
TTTAGCACTTGCATGGAGTCTGGTTCAGGTCAGGAATATATTGACGAGGAAGAGCTTTTAAACTTT
CCCAATTTGATGGTGGACATGGCAGGAGGAATGCTCGTAACCCCTCCCAGGATCAACTCACTCGCT
TCAGATGATTCACCAGAGATTTCAGATATAGAAAGCCTATGGACTTATCCTTAAAGGGGCTCTAAA
TTTACTGAGATAGCAGAAAGTACAAAATAAGAAATGTGATTGAAAAAGTAGATGAGATGATCACAA
ATGTGAAGGTATTTGTCCTTTTTGATCTCTTTTGGGCTGTTTCTGTCATGCCCTGTATCTGTATGC
ATTCCTGAGTATTGCTAGTTAAAGTTTGCTTGAGGTAAACTAAAAAAAAAAAA

SEQ ID NO: 388, Gossypium hirsutum - protein

MANLSPEVNPPTPQIPDSTLDLVQLPNHSNLPSIPTPNPVQYSWPGSGRHSSYRGIRSRSGKWVSE
IREPRKTTRIWLGTYPTPEMAATAYDVAAIALKGPDTDLNFPDMILSYPKVASTSAADIRAAAASA
AASRLPMPDTGSSKQDQGNLQNEGTASTFSTCMESGSGQEYIDEEELLNFPNLMVDMAGGMLVTPP
RINSLASDDSPEISDIESLWTYP

SEQ ID NO: 389, Gossypium hirsutum - DNA

CATTACTCATGATTCAAATTTCTGCCATATTACACACAAACAATGGCTGAATCTGATCCTTCTTCA
ACCAATGTGCCCCCGAAAGACCAGCCACCACCACCAACTGTTCCAATCCCTGACGCTCCTCCGCAA
GAGCAGTCGCCGAAACCATCATCCACTCCATTGGTCTCATCGAAAGAAGGCGTAAGTGGGAATCCC
ACATCGAGAAAGTTGTCGGCGGTTTATCGGGGAGTAAGAAGCAGGAGTGGGAAATGGGTGTCGGAA
ATACGTGAGCCGCGTAAAACGACGCGTATATGGCTAGGGACATACCCTACACCTGAAATGGCAGCC
ACCGCGTATGACGTGGCTGCTCTTGCCCTAAAAGGTCCCGACGCGGAACTGAACTTTCCGGATATG
GTTCATTCGTATCCGAAAGTGGGTTCTACATCGGCAACTGATATTCGTGCCGCCGCTGCTAGTGCC
GCCGCTTCTAGACTACTACCCAAGTCTGTTACCAATACTGGGTCCTTATCAAAAACGAGGACACC
ACATCGACTACTGCTATGGAGATTACCTGTTCAGGTCAAGAATTTATCGACGAGGAAGAGCTTTTA
AACTTTCCCAATTTGGTGGTGGATATGGCAGGGGAATGCTAGTTAGCCCTCCAAACTGGATAAAC
TCACCACCTTCTGATGATTCACCAGATAATTCAGATGTAGATACACTATGGACTTACACTTAAAAT
AGAAAAATTCACTGTAAAAGTGATGAATGAGAGAGTATAAAGTCCAATGAAATGTAGAAGAAGA
AGCATGGTTTGAAAACTAGGGTCTAGATGCTACTGATGATTCAGTAATATGAAATGCAGAAGGTAC
TGTCATTTGTCCTTTTTTTCCCTCTGTCCCTTCTGGTTTTTATCTCTTTTAGGGGTTGTTCCATT
GCTGGAAAAACATATGAACAAATCAGAAGCCAATATAAGAAGAATCTGAGTGGTTTTACATATCTG
TTGCAATATTGATGCTATTATAAAGCTTGGGTTTTCTTTTGTTTTTTAAAAAAAAAAAAAAAAAA
AAAAAAA

FIGURE 27 (continued)

SEQ ID NO: 390, Gossypium hirsutum - protein

MAESDPSSTNVPPKDQPPPPTVPIPDAPPQEQSPKPSSTPLVSSKEGVSGNPTSRKLSAVYRGVRS
RSGKWVSEIREPRKTTRIWLGTYPTPEMAATAYDVAALALKGPDAELNFPDMVHSYPKVGSTSATD
IRAAAASAAASRLLPKSVTNTGSLSKNEDTTSTTAMEITCSGQEFIDEEELLNFPNLVVDMAGGML
VSPPNWINSPPSDDSPDNSDVDTLWTYT

SEQ ID NO: 391, Gossypium hirsutum - DNA

GGCCATTACGGCCGGGGAGAAAAAGAAAGCTCATTTAGTTAATATTTTCCCTTGCATTTCCAAATT
CGGAAGTTCATACAGCAAGTGATTTCCTAAAATACTTGGATCCTAAGTACGAATATCCTTTTCTTG
AAATATACTCTTTTTAAGTCAAAAGCTTTGTTTAACTGAAACTTAAACTGATTACTGTTTGGGTTT
TTTTTTTAAATGGATTTTGTAGTTCAAGATTATGATATGGTTGATTCTGGGTCGGTTTCTGAAAGT
GGAACTGATCGTCCGGTGAATTTTTCCGATGAATATGTGATGTTAGCTTCGAGTTATCCAAAGAGG
CCCGCGGGAAGGAAGAAGTTCCGGGAGACTCGACACCCGGTGTACCGTGGAGTTCGCCGGAGGAAT
CCCGGGAAGTGGGTTTCTGAAGTGAGGGAGCCTAATAAGAAGTCGAGGATTTGGCTTGGAACTTTC
CCGAAGGCGGATATGGCGGCGCGTGCTCACGACGTGGCAGCTATAGCACTGAGAGGGAAGTCAGCT
TGTTTGAACTTCGCTGACTCAGCTTGGAAGCTTCCGGTCCCGGCTTCTTCCGACCCAAAGGATATC
CAAAAGACGGTGGCGGAGGTGGCGGAGACTTTCAGAACGGCTGAGCATTCGAGCGGGAATTCTAGA
AACGATGCAAAGAGAAGTGAAAACACGGAGATGGAGAAAGGGTTTTACTTGGACGAAGAAGCGTTG
TTTGGGACACAAAGATTTTGGGCAAATATGGCTGCCGGTATGATGATGTCACCTCCTCGTTCCGGT
CATGACGGAGGATGGGAGGAACATGAAGTCGATGATTATGTACCTTTATGGAGTTATTCTATTTAA
AAGTAAAATTTTTCAGACATTTTCAAGCATTCATTGGAATTTTTAGTTCACAGAAATCGCCACCGG
CAATTGCCCTTTATGTTTTGTACGTACAACGATTTTTTTGGATTGTACGGGTAGTGCTGTAAGTAA
AAAGATTAATGTGTATATATACGATGTATATATACTTCATAGCTTCTCCAAACAATAAATTTATAG
CTTCATATCTATTTTACCATCAAAAAAAAAAAAAAAAAAAAAAAA

SEQ ID NO: 392, Gossypium hirsutum - protein

MDFVVQDYDMVDSGSVSESGTDRPVNFSDEYVMLASSYPKRPAGRKKFRETRHPVYRGVRRRNPGK
WVSEVREPNKKSRIWLGTFPKADMAARAHDVAAIALRGKSACLNFADSAWKLPVPASSDPKDIQKT
VAEVAETFRTAEHSSGNSRNDAKRSENTEMEKGFYLDEEALFGTQRFWANMAAGMMMSPPRSGHDG
GWEEHEVDDYVPLWSYSI

SEQ ID NO: 393, Gossypium hirsutum - DNA

ATGGATTTTGTAGTTCAAGATTATGACATGGTTGATTTCGGGTCGGTTTCTGAAAGTGGAACTGAT
CGTCCGGTGAATTTTTCCGATGACTATATGATGTTAGCTTCGAGTTATCCAAAGAGGCGAGCTGGG
AGGAAGAAGTTCCGGGAGACTCGACACCCGGTGTACCGTGGAGTTCGCCGGAGGAATCCCGGGAAG
TGGGTTTCTGAAGTGAGGGAGCCTAATAAGAAGTCGAGGATTTGGCTTGGAACTTTCCCGAAGGCG
GATATGGCGGCGCGTGCTCACGACGTGGCAGCTATAGCACTGAGAGGGAAGTCAGCTTGTTTGAAC
TTCGCTGACTCAGCTTGGAAGCTTCCGGTCCCGGCTTCTTCCGACCCAAAGGATATCCAAAAGACG
GTGGCGGAGGTGGCGGAGACTTTCAGAACGGCTGAGCATTCGAGCGGGAATTCTAGAAACGATGCA
AAGAGAAGTGAAAACACGGAGATGCAGAAAGGGTTTTACTTGGACGAAGAAGCGTTGTTTGGGACA
CAAAGATTTTGGGCAAATATGGCTGCCGGTATGATGATGTCACCTCCTCGTTCCGGTCATGACGGA
GGATGGGAAGAACATGAAGTCGATGATTATGTACCTTTATGGAGTTATTCTATTTAAAAGTAATTT
TTTCAGACATTTTCAAGCATTCATTGGAATTTTTAGTTCGTAGAAATCGCCACCGGCAATTGCCCT
TTATGTTTTGTACGTACAACGGTTTTTTGGATTGTACGGGTAGTGTTGTAAGTAAAAAGATTAAT
GTGTATATATACGATGTATATATACGTCATAACTTCTCCAAACAATAAATTTATAGCTTCATATCC
AAAAAAAAAAAAAAAAAAAAAAAAAAA

FIGURE 27 (continued)

SEQ ID NO: 394, Gossypium hirsutum - protein

MDFVVQDYDMVDFGSVSESGTDRPVNFSDDYMMLASSYPKRRAGRKKFRETRHPVYRGVRRRNPGK
WVSEVREPNKKSRIWLGTFPKADMAARAHDVAAIALRGKSACLNFADSAWKLPVPASSDPKDIQKT
VAEVAETFRTAEHSSGNSRNDAKRSENTEMQKGFYLDEEALFGTQRFWANMAAGMMMSPPRSGHDG
GWEEHEVDDYVPLWSYSI

SEQ ID NO: 395, Gossypium hirsutum - DNA

ATTTTCCCTTGCATTTCCAAATTCGGAAGTTCATACAGCAAGCGATTTCCTAAAATACTTGGATAC
TAAGAGCGAATATCCTTTTCTTGAAATATACTCTTTTCAAGTCAAAAGCTTTGTTTAACTGGAACT
TAAACTGATTTACTGTTTGGGTTTTTTTAAAATGGATTTTTTAGTTCAAGATTATGATATGGTTGA
TTCTGGGTCGGTTTCTGAAAGTGGAACTGATCGTCCGGTGAATTTTTCCGATGGCTATGTGATGTT
AGCTTCGAGTTATCCAAAGAGGCGAGCTGGGAGGAAGAAGTTCCGGGAGACTCGACACCCGGTGTA
CCGTGGAGTTCGCCGGAGGAATCCCGGGAAGTGGGTTTCTGAAGTGAGGGAGCCTAATAAGAAGTC
GAGGATTTGGCTTGGAACTTTCCCGAAGGCGGATATGGCGGCGCGTGCTCACGACGTGGCAGCTAT
AGCACTGAGAGGGAAGTCAGCTTGTTTGAACTTCGCTGACTCAGCTTGGAAGCTTCCGGTCCCGGC
TTCTTCCGACCCAAAGGATATCCAAAAGACGGTGGCGGAGGTGGCGGAGACTTTCAGAACGGCTGA
GCATTCGAGCGGGAATTCTAGAAACGATGCAAAGAGAAGTGAAAACACGGAGATGGAGAAAGGGTT
TTACTTGGACGAAGAAGCGTTGTTTGGGACACAAAGATTTTGGGCAAATATGGCTGCCGGTATGAT
GATGTCACCTCCTCGTTCCGGTCATGACGGAGGATGGGAAGAACATGAAGTCGATGATTATGTACC
TTTATGGAGTTATTCTATTTAAAAGTAAAATTTTTCAGACATTTTCAAGCATTCATTGGAATTTTT
AGTTCACAGAAATCGCCACCGGCAATTGCCCTTTATGTTTTGTACGTACAACGATTTTTTTGGATT
GTACGGGTAGTGCTGTAAGTAAAAAGATTAATGTGTATATATACGATGTATATATACTTCATAGCT
TCTCCAAACAATAAATTTATAGCTTCATATCTATTTTACCATCAAAAAAAAAAAAAAAAA

SEQ ID NO: 396, Gossypium hirsutum - protein

MDFLVQDYDMVDSGSVSESGTDRPVNFSDGYVMLASSYPKRRAGRKKFRETRHPVYRGVRRRNPGK
WVSEVREPNKKSRIWLGTFPKADMAARAHDVAAIALRGKSACLNFADSAWKLPVPASSDPKDIQKT
VAEVAETFRTAEHSSGNSRNDAKRSENTEMEKGFYLDEEALFGTQRFWANMAAGMMMSPPRSGHDG
GWEEHEVDDYVPLWSYSI

SEQ ID NO: 397, Glycine max - DNA

ATGGAAGAAGCGGGTTTAGGAGATTGTTGTTCCTCTAATACGACTATTACGAGGAAAAGCGAGAAG
CGAAAGCAGCAGCACCAACAACAAGAGAAGCCATACAGAGGAATAAGGATGAGGAAGTGGGGCAAG
TGGGTGGCGGAGATTAGAGAACCCAACAAGAGGTCGAGGATCTGGTTGGGTTCTTACGCCACCCCC
GTCGCCGCCGCACGCGCCTACGACACCGCCGTCTTCCACCTCCGAGGCCCTTCCGCTCGCCTTAAC
TTCCCCGAATTGCTGTCCCAGGACGACGACGTTTCGACCCAACAACAGGGCAAGATGTCCGCCGAT
TCAATTCGCCAAAAAGCGACCCAAGTCGGCGCCAGAGTCGACGCGCTCCAAACCGCGCTTCAGCAA
TCCTCGTCGACACACTCCATTAGTTCCAGCCACGTCAGCTATGAGAAACCAGACTTGAACGAGTAT
CCCAAACCTGAAGATTAG

SEQ ID NO: 398, Glycine max - protein

MEEAGLGDCCSSNTTITRKSEKRKQQHQQQEKPYRGIRMRKWGKWVAEIREPNKRSRIWLGSYATP
VAAARAYDTAVFHLRGPSARLNFPELLSQDDDVSTQQQGKMSADSIRQKATQVGARVDALQTALQQ
SSSTHSISSSHVSYEKPDLNEYPKPED

FIGURE 27 (continued)

SEQ ID NO: 399, Glycine max - DNA

GCAAAGTTTCCAAATTGAATGCAAAAACAGAAACTTCTTCCTCAAATGCCTTCTGGGTCGCTCTTC
TTTCTATCCAGATTACGAAGATTTCGGTCGCCAGTTGTGATTCAAGTGCTATTTTAGCATTTTTTT
TTTACCTGGACGGTAAGGGTCAACTTGCATGCACATGTTAGTGAAAAACCACAATAAGGGGGATGG
ATCTAAGTCCCTGGCCGATACACTGGCGAAATGGAAGAATATAATGCCTGGCTGGAGTCTAACAA
TGAAGCTGAGAAGCCGGTTAGGAAGGTCCCTGCCAAGGGATCAAAGAAGGGATGTATGAAAGGCAA
AGGAGGACCTGAGAACTTGCGCTGTAATTACAGAGGAGTTAGGCAAAGGACATGGGGAAAATGGGT
TGCTGAAATCCGAGAGCCAAACAGAGGAAGTAGGCTCTGGTTGGGTACTTTTCCTACTGCCATTAG
CGCTGCTCTTGCTTATGATGAAGCAGCGATGGCAATGTATGGTTTCTGTGCACGCCTCAACTTTCC
CAATGTTCAAGTTTCAACTTTTTCCGAGGAACCGTCTAGAAATTCTCCAGCTGCTGCTTACCAGTC
AAGAAATTCTCCATCTGCTAAAGAATCCGGTTCTGCGTTGGTGATATTAGAGAGGTCTGAGTGCAT
GATGTTGTGGAACAATTCTGGTGGAGATGCAGCAGAGGATGATGGCATGGAAGACCTTTCCTTATC
CTTAAGTGTGAAACATGAGGAAGGGGAGGATGAATCAGGGACCAGTTCTTCCTATCTTTCATTGTC
TTGATGTATGGTTTGCATACTCTGATTTGGCCGTGGCTGGAAATCATAGCCTTCATAGAGGTGGAT
GATTAGCTTAGGATGAACGAATCTTGATATTAGTACCTGGAGATTAGCTGTTGTAAAATTGACTTG
GTTGAGAAGTGTTCCATTCTTCAGGAATTGACCTAATGCAATCTGGATATCCAGTCAAGTTGTAAG
ATGTGAAATGTATTTTGCCTTGCATGATAGATGACT

SEQ ID NO: 400, Glycine max - protein

MHMLVKNHNKGDGSKSLADTLAKWKEYNAWLESNNEAEKPVRKVPAKGSKKGCMKGKGGPENLRCN
YRGVRQRTWGKWVAEIREPNRGSRLWLGTFPTAISAALAYDEAAMAMYGFCARLNFPNVQVSTFSE
EPSRNSPAAAYQSRNSPSAKESGSALVILERSECMMLWNNSGGDAAEDDGMEDLSLSLSVKHEEGE
DESGTSSSYLSLS

SEQ ID NO: 401, Glycine max - DNA

GTTTTGGAATTGAGACAGGCTTTATTTATAATTTTAAAAACTTGTTTCCCTCCCTCCCTTATTTTT
GGGTTTTCTCAACTTGTTCTTGTCATCTTGTAAAACATGGGAACTGCTATAGACATGTACAACAGC
AGCAACATCGTAGCGGATTTCCTAGATCCGTATAGTGAAGAGCTGATGAAAGCACTTAAGCCTTTT
ATGAAAAGTGATTATTTCTCTGCCTCTTCTTCTTCTTCACTCGAATCACAGCCTTGTTCTTTTTCA
TCTAATTCTCTCCCCACTTCGTATCCCTCTTCCAACCAAATCAAGCTCAACCAACTCACCCCAGAC
CAAATTGTTCAGATTCAGGCCCAAATCCACATTCAGCAGCAGCAGCAGCACGTGGCCCAAACCCAA
ACCCACCTGGGCCCAAAACGCGTCCCCATGAAGCACGCTGGCACGGCCGCGAAACCCACGAAGCTC
TACCGCGGGGTGCGGCAACGGCATTGGGGCAAGTGGGTCGCTGAAATCAGACTCCCAAAGAACCGC
ACGCGCCTCTGGCTAGGAACATTCGACACCGCAGAGGAAGCAGCATTAGCGTACGACAACGCAGCG
TTTAAGCTCAGAGGCGAGTTCGCGCGTCTCAATTTTCCTCATCTAAGACACCACGGAGCCTTCGTT
TTCGGCGAGTTCGGAGATTACAAGCCTCTACCTTCTTCCGTGGATTCCAAACTGCAAGCTATTTGC
GAAAGCTTAGCGAAACAAGAGGAAAAGCCGTGTTGCTCCGTCGAAGACGTGAAGCCCGTGATACAC
GCTGCTGAGCTGGCAGAGGTCGAGTCTGACGTGGCAAAATCGAACGCTGAATATGTTTATCCCGAG
TTCGAGGATTTTAAGGTCGAGCACGAGAACCCAATGTTTCTGGTGAATCTTCTTCGCCTGAATCC
AGTGTTACTTCTTGGATTTCTCGGACTTCTCGGATTCTAATAATCAGTGGGATGAAATGGAGAAT
TTTGGGTTGGAGAAGTTCCCTTCTGTGGAGATTGATTGGAAGCTATATGATGACTCGGTGAATTT
TCGTTATGTCAAATGGTTGGT

FIGURE 27 (continued)

SEQ ID NO: 402, Glycine max - protein

MGTAIDMYNSSNIVADFLDPYSEELMKALKPFMKSDYFSASSSSSLESQPCSFSSNSLPTSYPSSN
QIKLNQLTPDQIVQIQAQIHIQQQQQHVAQTQTHLGPKRVPMKHAGTAAKPTKLYRGVRQRHWGKW
VAEIRLPKNRTRLWLGTFDTAEEAALAYDNAAFKLRGEFARLNFPHLRHHGAFVFGEFGDYKPLPS
SVDSKLQAICESLAKQEEKPCCSVEDVKPVIHAAELAEVESDVAKSNAEYVYPEFEDFKVEHENPM
FSGESSSPESSVTFLDFSDFSDSNNQWDEMENFGLEKFPSVEIDWEAI

SEQ ID NO: 403, Glycine max - DNA

ATGGCGAAACCCAGCAGCGAAAAGCCAGAGGAGCATAGCGATTCCAAGTACTACAAAGGGGTCCGA
AAGAGAAAATGGGGCAAATGGGTATCCGAAATAAGACTACCCAACAGCCGTCAGAGGATTTGGTTG
GGATCCTACGACACCCCCGAGAAGGCCGCGCGTGCCTTCGACGCGGCAATGTTCTGCTTACGTGGC
CGCAACGCCAAGTTTAACTTCCCCGACAACCCACCCGACATCGCCGGCGGAACGTCCATGACGCCG
TCGCAGATTCAGATCGCCGCCGCACAATTCGCCAACGCGGGGCCCCACGAGGGACATTCGGGCCGA
CCCGAACATCCTCCCATGGAATCTCCATCGCCTTCTGTTTCGGAAGGGACCATCCAAACGGACAGT
GACGTCCCCACTCTTAACGGTTCAGTAACGGATTTGTTCACGCCCGTTGGGTCGAGTGGTTACGCA
TCCGATTACGGGATTTTCCCGGGCTTTGATGATTTCAGTGGCGATTTTTATGTGCCGGAAATGCCG
AACGTTAATTATGGAGAAGAAAACGGGGAAGGGTTCATAGTTGATGAATCTTTCTTGTGGAATTTT
TGA

SEQ ID NO: 404, Glycine max - protein

MAKPSSEKPEEHSDSKYYKGVRKRKWGKWVSEIRLPNSRQRIWLGSYDTPEKAARAFDAAMFCLRG
RNAKFNFPDNPPDIAGGTSMTPSQIQIAAAQFANAGPHEGHSGRPEHPPMESPSPSVSEGTIQTDS
DVPTLNGSVTDLFTPVGSSGYASDYGIFPGFDDFSGDFYVPEMPNVNYGEENGEGFIVDESFLWNF

SEQ ID NO: 405, Glycine soja - DNA

GGCTTTCTCAGTTCCCTCTTTCCCTATCAAAATCCTTTCCCACAACACTACTCACTCCAGTCCAAG
AAACCCTTTTTCAATTTGGTTTCAACAGCACACACACACACACACATATATATATATATATAGCAT
GTTTACCTTGAATCATTCTTCTGATTTGTACCATGTTTCCCCTGAGCTCTCATCTTCCTTGGACAC
ATCCTCGCCGGCTTCGGAGGGCTCTCGTGGCGTGGCATTTTCCGACGAGGAGGTGCGGCTGGCGGT
GAGGCACCCGAAGAAGCGGGCAGGTCGGAAGAAGTTCCGGGAGACGCGCCACCCGGTGTACCGGGG
GGTGAGGAGGAGGAACTCGGATAAGTGGGTGTGTGAGGTGAGGGAGCCCAACAAGAAGACCAGGAT
TTGGCTGGGGACTTTCCCCACGCCGGAGATGGCGGCTCGGGCGCACGACGTGGCGGCAATGGCCCT
GAGGGGCCGGTATGCCTGTCTAAACTTTGCTGACTCGGCCTGGCGGTTACCTGTTCCCGCCACGGC
CGAGGCAAAGGATATACAGAAGGCAGCAGCAGAAGCTGCCCAGGCTTTCAGACCAGATCAAACCTT
AAAAAATGCTAATACAAGGCAGGAGTGTGTGGAGGCGGTGGCGGTGGCGGTGGCGGACACAACAAC
GGCCACGGCACAAGGGGTGTTTTATATGGAGGAAGAAGAGCAGGTGTTGGATATGCCTGAGTTGCT
TAGGAATATGGTGCTCATGTCCCCAACACATTGCTTAGGGTATGAGTATGAAGATGCTGACTTGGA
TGCCCAAGATGCTGAGGTGTCACTATGGAATTTCTCAATTTAATAATGTGTTTTGGTTTGGTTTTT
GATGTTACTTTTTTGGAGTGAACAGTGTCTGTACTGGTTTTTTATTACTAGTACGGATACTAGTT

SEQ ID NO: 406, Glycine soja - protein

MFTLNHSSDLYHVSPELSSSLDTSSPASEGSRGVAFSDEEVRLAVRHPKKRAGRKKFRETRHPVYR
GVRRRNSDKWVCEVREPNKKTRIWLGTFPTPEMAARAHDVAAMALRGRYACLNFADSAWRLPVPAT
AEAKDIQKAAAEAAQAFRPDQTLKNANTRQECVEAVAVAVADTTTATAQGVFYMEEEEQVLDMPEL
LRNMVLMSPTHCLGYEYEDADLDAQDAEVSLWNFSI

FIGURE 27 (continued)

SEQ ID NO: 407, Brassica napus - DNA

TGCTGCATGAATTCGGCACGAGGAGAGAAATAAATATCTTATCAAACCAGACAGAACAGAGATCTT
GTTACTTACTATACTACACTCAGCCTTATCCAGTTTTTCAAAAGAAGTTTTCAACGATGAACTCAG
TCTCTACTTTTTCTGAACTTCTTGGCTCCAGAACGAGTCTCCGGTAGGTAGTGATTACTGTCCCA
TGTTGGCGGCGAGCTGTCCGAAGAAGCCGGCGGGTAGGAAGAAGTTTCGGGAGACACGCCACCCCA
TTTACAGAGGAGTTCGTCTTAGAAAGTCAGGTAAGTGGGTGTGTGAAGTGAGGGAACCAAACAAGA
AATCTAGAATTTGGCTCGGAACTTTCAAAACAGCTGAGATCGCAGCTCGTGCTCACGACGTCGCCG
CCTTAGCTCTCCGTGGAAGAGGCGCCTGCCTCAACTTCGCCGACTCGGCTTGGCGGCTCCGTATCC
CGGAGACAACCTGCGCCAAGGATATCCAGAAGGCTGCTGCTGAAGCCGCATTGGCTTTTGAGGCCG
AGAAGAGTGATACCACGACGAATGATCATGGCATGAACATGGCTTCTCAGGTTGAGGTTAATGACA
CGACGGATCATGACCTGGACATGGAGGAGACGATAGTGGAGGCTGTTTTTAGGGAGGAACAGAGAG
AAGGGTTTTACATGGCGGAGGAGACGACGGTTGTGGGTGTTGTTCCGGAGGAACAGATGAGCAAAG
GGTTTTACATGGACGAGGAGTGGATGTTCGGGATGCCGACCTTGTTGGCTGATATGGCGGCAGGGA
TGCTCTTACCGCTGCCGTCCGTACAATGGGGACATAATGATGACTTCGAAGGAGTTGCTGACATAA
ACCTCTGGAGTTATTAGTACTCGTATTTTCTTAAAATTATTTTTGGAATGATAATATTTTATTGA
ATTCGGATTCTACCTATTTTTTTAATGGATATCCTTTTTTCTGGTAGTGTGAGAAACGATTGTG
AATGTTTCCACAAAAGTGTTGGCAATGTTGTCAAATGCTGGGTATTTTGTGCAGCATAGTCATCTT
GGTTTCCTTATATGCAGCAACTAAATTTTAGTTTTTAAGTAAAAACAGAAGAGGAAAGAGAATGAA
TGTTATTAAATAAAGAAAGAAAAATCTAAAGGTGGGTTTAGTATGAAAAAAAAAAAAAAAAAA

SEQ ID NO: 408, Brassica napus - protein

MNSVSTFSELLGSENESPVGSDYCPMLAASCPKKPAGRKKFRETRHPIYRGVRLRKSGKWVCEVRE
PNKKSRIWLGTFKTAEIAARAHDVAALALRGRGACLNFADSAWRLRIPETTCAKDIQKAAAEAALA
FEAEKSDTTTNDHGMNMASQVEVNDTTDHDLDMEETIVEAVFREEQREGFYMAEETTVVGVVPEEQ
MSKGFYMDEEWMFGMPTLLADMAAGMLLPLPSVQWGHNDDFEGVADINLWSY

SEQ ID NO: 409, Brassica napus - DNA

AATTCGGCACGAGCTGAGAGATAAATTAAACATTTATCAAACCAACGAAACATAGATCTTTGTACT
TACTATACTTCACCTTATCCAGTTTTATTTTTTATTTATAAAGAGTTTTCAACAATGACCTCATT
TTCTACCTTTTCTGAACTGTTGGCTCCGAGCATGAGTCTCCGGTTACATTAGGCGAAGAGTATTG
TCCGAAGCTGGCCGCAAGCTGTCCGAAGAAACCAGCCGGCCGGAAGAAGTTTCGAGAGACGCGTCA
CCCAGTTTACAGAGGAGTTCGTCTGAGAAACTCAGGTAAGTGGGTGTGTGAAGTGAGGGAGCCAAA
CAAGAAATCTAGGATTTGGCTCGGTACTTTCCTAACAGCCGAGATCGCAGCCCGTGCTCACGACGT
CGCCGCCATAGCCCTCCGCGGCAAATCAGCTTGTCTCAATTTTGCCGACTCCGCTTGGCGGCTCCG
TATCCCGGAGACAACATGCCCCAAGGAGATTCAGAAGGCGGCTGCTGAAGCCGCGGTGGCTTTTAA
GGCTGAGATAAATAATACGACGGCGGATCATGGCATTGACGTGGAGGAGACGATCGTTGAGGCTAT
TTTCACGGAGGAAAACAACGATGGTTTTTATATGGACGAGGAGGAGTCCATGTTCGGGATGCCGGC
CTTGTTGGCTAGTATKGCTGAAGGAATGCTTTTGCCGCCTCCGTCCGTACAATTCGGACATACCTA
TGACTTTGACGGAGATGCTGACGTGTCCCTTTGGAGTTATTAGTACAAAGATTTTTATTTCCATT
TTTGGTATAATACTTCTTTTTGATTTTCGGATTCTACCTTTTTATGGGTATCATTTTTTTTTTAGG
TAACGTGGAAGCTGAGTGTAAATGTTTGAACAATTGTGTTATAAAATGCTAGTATTTTGTGTGCA
AAAAAAAAAAAAAAAAAAAA

FIGURE 27 (continued)

SEQ ID NO: 410, Brassica napus - protein

MTSFSTFSELLGSEHESPVTLGEEYCPKLAASCPKKPAGRKKFRETRHPVYRGVRLRNSGKWVCEV
REPNKKSRIWLGTFLTAEIAARAHDVAAIALRGKSACLNFADSAWRLRIPETTCPKEIQKAAAEAA
VAFKAEINNTTADHGIDVEETIVEAIFTEENNDGFYMDEEESMFGMPALLASXAEGMLLPPPSVQF
GHTYDFDGDADVSLWSY

SEQ ID NO: 411, Brassica napus - DNA

AAATTATACAAAAGAGTTCGAGCTCTTGATTACTTAATTAAAAACAAATTTTACTTCTCTTTTTT
TTATGGTCTTTTGTCATGATCTGAAATACGGTCTTTGTTGATAAATCATATATGCCGATTTTGATT
TTTAATCCACCTGAGAGATAAATTAAACATTTATCAAACCAACGAAACATAGATCTTTGTAGTTAC
TTATCCAGTTTATTTTTTAAAAAATTATAAAGAGATTTCAACAATGACCTCATTTTCTACCTTTTC
TGAAATGTTGGGCTCCGAGTATGAGTCTCCGGTTACGTTAGGCGGAGAGTATTGTCCGAAGCTGGC
CGCGAGCTGTCCGAAGAAACCAGCCGGTCGTAAGAAGTTTCGGGAGACGCGTCACCCAGTTTATAG
AGGAKTTCGTCTGAGAAACTCAGGTAAATGGGTGTGTGAAGTGAGGGAGCCAAACAAGAAATCCAG
GATTTGGCTCGGTACTTTCTTAACCGCCGAGATCGCAGCTCGTGCTCACGACGTCGCCGCCATAGC
CCTCCGCGGCAAATCAGCTTGTCTCAATTTTGCTGACTCGGCTTGGCGGCTCCGTATCCCGGAGAC
AACATGCCCCAAGGAGATTCAGAAGGCGGCTGCTGAAGCCGCCTTGGCTTTTCAGGCTGAGATAAA
TAATACGACGACGGATCATGGCCTGGACATGGAGGAGACGATCGTGGAGGCTATTTTCACGGAGGA
AAACAACGATGTGTTTTATATGGACGAGGAGTCCATGTTAGAGATGCCGGCCTTGTTGGCTAGTAT
GGCGGAAGGAATGCTTTTGCCGCCGCCGTCCGTACATTTCGGACATAACTATGACTTTGACGGAGA
TGCTGACGTGTCCCTTTGGAGTTATTAGTGCAAATTTTTTTTCAATTTTTTCGTATAATATTCTT
TTGGATTTTCGGATTCTGCCTTTTTATGGGAATCTTTTTTTTTTGGTAATGTGGAAGCTGAGTGT
GAATGTTTAAACAATTGTGTTATCAAATGCTAGTATTTTTTTGTGCAGCCTCGTGCCGAATCCTGC
AGCCC

SEQ ID NO: 412, Brassica napus - protein

MTSFSTFSEMLGSEYESPVTLGGEYCPKLAASCPKKPAGRKKFRETRHPVYRGXRLRNSGKWVCEV
REPNKKSRIWLGTFLTAEIAARAHDVAAIALRGKSACLNFADSAWRLRIPETTCPKEIQKAAAEAA
LAFQAEINNTTTDHGLDMEETIVEAIFTEENNDVFYMDEESMLEMPALLASMAEGMLLPPPSVHFG
HNYDFDGDADVSLWSY

SEQ ID NO: 413, Brassica napus - DNA

CCCCTCGAGGTTTGTTCGCCTCTAGTTCCAGAGGCCAGTATAAAAAACACCAACTCTCACTCCCAA
CTTTTTTATCGAACTACAAACTTTAGAATCCACCTGAAAGATAAAATAAACATTTATCAAACCATC
AGAACTGAGATCTTTCTAGTCTCTTACTATACTTAACCTTATCCAGTTAACAATGACCTCATTTTC
TGCCTTCTCTGAAATGATGGGCTCCGAGAACGAGTCTCCTGCATTAAGCGGGGAGTATTGTCCGAC
GCTGGCCGCGAGCTGTCCGAAGAAACCTGCGGGTCGGAAGAAGTTTCGGGAGACGCGTCACCCAAT
TTACAGAGGAGTTCGTCAGAGACACTCAGGTAAGTGGGTGTGCGAGGTGAGAGAGCCAAACAAGAA
ATCCAGGATTTGGCTCGGKACTTTCCTAACCGCCGAGATCGCAGCTCGTGCTCACGACGTCGCCGC
CATAGCCCTCCGTGGCAAATCCGCCTGCCTCAATTTCGCCGACTCGGCTTGGCGGCTCCGTATCCC
GGAGACAACATGCCCCAAGGATATCCAGAAGGCGGCTGCTGAAGCCGCGGTGGCTTTTCAGGCTGA
GATAAATGATACGACGACGGATCATGGCCTGGACGTGGAGGAGACGATCGTGGAGGCTATTTTTAC
GGAGGAAAACAACGATGGGTTTTATATGGACGAGGAGGAGTCCATGTTCGGGATGCCGTCCTTGTT
GGCTAGCATGGCGGAAGGGATGCTTTTGCCGCCACCGTCGGTACGATTCGAACATAAMTATGACTT
TGACGGAGATGCCGAMGTGTCCCTTTGGAGTTATTAATACAGAGATTTTTATTTCCAGTTTTTGT
ATAATACTTTTTTTTTGGATT

FIGURE 27 (continued)

SEQ ID NO: 414, Brassica napus - protein

MTSFSAFSEMMGSENESPALSGEYCPTLAASCPKKPAGRKKFRETRHPIYRGVRQRHSGKWVCEVR
EPNKKSRIWLGTFLTAEIAARAHDVAAIALRGKSACLNFADSAWRLRIPETTCPKDIQKAAAEAAV
AFQAEINDTTTDHGLDVEETIVEAIFTEENNDGFYMDEEESMFGMPSLLASMAEGMLLPPPSVRFE
HXYDFDGDAXVSLWSY

SEQ ID NO: 415, Brassica oleracea - DNA

ATGAACTCAGTCTCTACTTTTTCTGAACTTCTTGGCTCTGAGAACGAGTCTCCGGTAGGTGGTGAT
TACTGTCCCATGTTGGCGGCGAGCTGTCCGAAGAAGCCGGCGGGTAGGAAGAAGTTTCGGGAGACA
CGTCACCCCATTTACCGAGGAGTTCGCCTTAGAAAATCAGGTAAGTGGGTGTGTGAAGTGAGGGAA
CCAAACAAAAAATCTAGGATTTGGCTCGGAACTTTCAAAACAGCTGAGATCGCAGCTCGTGCTCAC
GACGTCGCCGCCTTAGCTCTCCGTGGAAGAGGCGCCTGCCTCAACTTCGCCGACTCGGCTTGGCGG
CTCCGTATCCCGGAGACAACCTGCGCCAAGGATATCCAGAAGGCTGCTGCTGAAGCCGCATTGGCT
TTTGAGGCCGAGAAGAGTGATACCACGACGAATGATCATGGCATGAACATGGCTTCTCAGGCTGAG
GTTAATGACACGACGGATCATGGCCTGGACATGGAGGAGACGATGGTGGAGGCTGTTTTTACTGAG
GAGCAGAGAGACGGGTTTTACATGGCGGAGGAGACGACGGTGGAGGGTGTTGTTCCGGAGGAACAG
ATGAGCAAAGGGTTTTACATGGACGAGGAGTGGATGTTCGGGATGCCGACCTTGTTGGCTGATATG
GCGGCAGGGATGCTCTTACCGCCGCCGTCCGTACAATGGGGACATAATGATGACTTCGAAGGAGAT
GCTGACATGAACCTCTGGAATTATTAG

SEQ ID NO: 416, Brassica oleracea - protein

MNSVSTFSELLGSENESPVGGDYCPMLAASCPKKPAGRKKFRETRHPIYRGVRLRKSGKWVCEVRE
PNKKSRIWLGTFKTAEIAARAHDVAALALRGRGACLNFADSAWRLRIPETTCAKDIQKAAAEAALA
FEAEKSDTTTNDHGMNMASQAEVNDTTDHGLDMEETMVEAVFTEEQRDGFYMAEETTVEGVVPEEQ
MSKGFYMDEEWMFGMPTLLADMAAGMLLPPPSVQWGHNDDFEGDADMNLWNY

PLANTS HAVING ENHANCED YIELD-RELATED TRAITS AND/OR INCREASED ABIOTIC STRESS RESISTANCE, AND A METHOD FOR MAKING THE SAME

RELATED APPLICATIONS

This application is a national stage application (under 35 U.S.C. §371) of PCT/EP2008/051225, filed Jan. 31, 2008, which claims benefit of European application 07101533.3, filed Jan. 31, 2007, U.S. Provisional Application 60/891,271, filed Feb. 23, 2007, European Application 07103194.2, filed Feb. 28, 2007, European Application 07104172.7, filed Mar. 14, 2007, European Application 07104242.8, filed Mar. 15, 2007, European Application 07104194.1, filed Mar. 15, 2007, U.S. Provisional Application 60/896,059, filed Mar. 21, 2007, U.S. Provisional Application 60/910,874, filed Apr. 10, 2007, U.S. Provisional Application 60/911,089, filed Apr. 11, 2007 and U.S. Provisional Application 60/911,289, filed Apr. 12, 2007.

The Sequence Listing associated with this application is filed in electronic format via EFS-Web and hereby incorporated by reference into the specification in its entirety. The name of the text file containing the Sequence Listing is Revised_Sequence_List__13987__00106_US. The size of the text file is 675 KB, and the text file was created on Apr. 18, 2010.

The present invention relates generally to the field of molecular biology and concerns a method for enhancing various economically important yield-related traits and/or increased abiotic stress resistance in plants. More specifically, the present invention concerns a method for enhancing yield-related traits in plants by modulating expression in a plant of a nucleic acid encoding a Yield Enhancing Protein (YEP). The YEP is selected from a Nucleosome Assembly Protein 1-like polypeptide (NAP1-like), a Like Sm polypeptide (Lsm protein), a truncated Cyclin H (CycH$_{Tr}$) polypeptide, a Remorin polypeptide, and a DREB protein. The present invention also concerns plants having modulated expression of a nucleic acid encoding such a YEP, which plants have enhanced yield-related traits relative to control plants. The invention also provides hitherto unknown YEP-encoding nucleic acids, and constructs comprising the same, useful in performing the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigor may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

Surprisingly, it has now been found that modulating expression in a plant of a nucleic acid encoding a Yield Enhancing Polypeptide (YEP) selected from a Nucleosome Assembly Protein 1-like polypeptide (NAP1-like), a Like Sm polypeptide (Lsm protein), a truncated Cyclin H (CycH$_{Tr}$) polypeptide, a Remorin polypeptide, and a DREB protein, gives plants having enhanced yield-related traits and/or increased abiotic stress resistance relative to control plants.

BACKGROUND

I. Nucleosome Assembly Protein 1-Like Polypeptide (NAP1-Like)

NAP proteins form a family of related proteins that are known in animals and are reported to be involved in chromatin-related activities. The family of NAP proteins is characterised by the presence of a conserved sequence known as the NAP domain. The NAP domain is described in the Pfam (accession PF00956) and Interpro databases (accession IPR002164). NAP is a component of a multifactor complex that mediates DNA packaging into nucleosomes (Krude, T. and Keller, C. (2001) Cell. Mol. Life. Sci. 58, 665-672). During the S phase of the eukaryotic cell division cycle, newly replicated DNA is rapidly assembled into chromatin. This process requires the coordinated action of several factors. In the initial stages, CAF1 (chromatin assembly factor 1) binds histone proteins H3 and H4 and directs them to the replication fork via PCNA binding. Subsequent deposition of histone proteins H2A and H2B is mediated by NAP1 proteins. NAP1 was first described in HeLA cells (von Lindern et al. (1992) Mol. Cell. Biol. 12, 3346-3355) and was later found conserved in all eukaryotes. In addition, NAP proteins are thought to regulate gene transcription and may influence cell differentiation and development.

SET proteins are highly related to NAP proteins and play a role in various cellular processes in humans. In human cells, SET has been shown to be associated with various CDK-cyclin complexes during the regulation of the cell cycle, such as G2/M transition. SET is a potent inhibitor of Protein Phosphatase 2A (PP2A) that is involved in several signalling pathways. The inhibitory activity of SET could be attributed to an acidic C-terminal domain (Canela et al. (2003) J. Biol. Chem. 278, 1158-1164). Other reports show the involvement of SET in DNA repair and transcription. SET is part of a complex that has DNA binding and bending activities mediated by the chromatin-associated protein HMG2. HMG2 facilitates the assembly of nucleoprotein higher-order structures by bending and looping DNA or by stabilizing underwound DNA. HMG2 co-precipitates with SET (Fan et al. (2002) Mol. Cell. Biol. 22, 2810-2820). SET is also reported to inhibit active DNA demethylation (Cervoni et al. (2002) J. Biol. Chem. 277, 25026-25031). The oncoprotein Set/TAF-I, involved in the inhibition of histone acetylation, also inhibits demethylation of ectopically methylated DNA resulting in gene silencing. Set/TAF-I is suggested to play a role in integrating epigenetic states of histones and DNA in gene regulation.

The activity of NAP1 proteins is in part regulated by phosphorylation. It was shown that subcellular localization of NAP1 in *Drosophila* is dependent on its phosphorylation state, which may be controlled by Casein Kinase II (Rodriguez at al (2000) J. Mol. Biol. 298, 225-238). Mammals are reported to possess several NAP1 proteins, while in yeast there is only one known NAP1 protein.

Plant NAP1 orthologues remain largely unknown, although NAP1 proteins were reported from soybean (Yoon et al (1995) Mol. Gen. Genet. 249, 465-473), *Arabidopsis*, tobacco, maize and rice (Dong et al. (2003) Planta 216, 561-570). Phylogenetic analysis of plant NAP1-like genes has revealed that there are two subgroups, one related to NAP1 and the other to the SET protein (FIG. 1). Most likely, later sequence divergence may have occurred since the two *Arabidopsis*, the two maize and the two tobacco sequences cluster together pointing to a more recent gene duplication effect. The *Saccharomyces cerevisiae* genome contains only one NAP-encoding gene, combining the functional properties of both the NAP1 and SET subgroups. Similarly, Template Activating Factor 1 (TAF-I), a homologue of NAP1, combines both PP2a inhibiting activity (Saito et al., Biochem. Biophys. Res. Comm. 259, 471-475, 1999) and chromatin remodelling activity (Kawase et al., Genes Cells 1, 1045-1056, 1996). It is therefore likely that the plant proteins of the NAP/SET family are largely redundant in function, particularly in the group of SET proteins where a lower degree of divergence is observed compared to the NAP group. Furthermore, there is structural evidence that NAP and SET proteins belong to the same family since they share the NAP domain which is followed by a C-terminal acidic region.

Little is known about the function of NAP1-like proteins in plants, although a role in mitosis and cytokinesis has been proposed (Dong et al 2003). The plant orthologues of the NAP1 protein most likely play a different role than their animal counterparts. Based on its nuclear localisation and on sequence similarities with the mammalian SET protein, a role in chromatin remodelling may be expected for the plant proteins. Furthermore, the plant NAP/SET group of proteins could be involved in the regulation of PP2A in plants. PP2A is one of the major phosphatases in plants, acting to a large extent on transcription factors and protein kinases, and proposed to regulate activity of proteins involved in a variety of cellular processes, including cell cycle (Ayaydin et al. (2000) Plant J. 23, 85-96), hormonal actions such as ABA mediated stomatal movement, germination (Kwak et al. (2002) Plant Cell 14, 2849-2861), or auxin transport and root development (Garbers et al 1996 EMBO J. 15, 2115-2124). PP2A is furthermore reported to be involved in photosynthesis and light signalling (Sheen (1993) EMBO J. 12, 3497-3505) and in nitrogen assimilation (Hirose and Yamaya (1999) Plant Physiology 121, 805-812). WO 2005/094562 discloses the use of NAP1-like proteins for increasing yield, but remains silent on the effects of modulated expression of NAP1-like proteins in plants that are suffering from abiotic stress.

II. Lsm (Like Sm) Protein

Ribonucleic acid (RNA), a nucleic acid polymer consisting of ribonucleotide monomers, is a key component in living organisms. It plays a crucial role in essential cellular function. RNA serves as the template for translation of genes into proteins, transferring amino acids to the ribosome to synthesize proteins. Some RNA molecules such as ribozymes also have catalytic activities and recently the role of RNA molecules as major regulators of gene expression has also been established.

The synthesis and function of messenger RNA (mRNA) in a cell requires a series of events including transcription, processing, transport, translation and degradation. RNA processing refers to events modifying RNA posttranscriptionally. In eukaryotic organisms the majority of the nascent pre-mRNA contains introns, which are spliced out resulting in the precise ligation of exons to produce a mature mRNA, which is the RNA form used by the ribosomes to translate into a protein. Posttranscriptional modification of RNAs also includes capping at the 5' end and polyadenylation at the 3' end, which affects stability and the efficiency of translation. The relationship between mRNA translation and turnover is critical to the regulation of gene expression and to the correct functioning of the cell. In higher eukaryotic organism several hundreds of proteins are involved in RNA metabolism. An example of such proteins are the Lsm proteins (Like Sm proteins).

Lsm (Like Sm) proteins were so named because of the structural similarity to the previously described Sm proteins. Lsm proteins are small proteins associated with the core spliceosomal snRNAs (small nuclear RNAs) and snRNPs (small nuclear ribonuclear proteins). Lsm proteins contain an Lsm domain of variable length, typically between 50 to 70 amino-acids long that includes two short stretches of conserved amino-acids separated by a variable region. By comparison to the Sm proteins, it has been suggested that Lsm proteins form a heterohepta- or hexameric complex in which seven or six Lsm proteins are arranged in a ring with a central aperture (Kambach C, et al. Cell 1999; 96:375-387; Khusial P, et al. Trends Biochem Sci. 2005 September; 30(9):522-8; Zaric B, et al. J Biol. Chem. 2005 Apr. 22; 280(16):16066-75).

The family of Sm-like proteins has been expanded during evolution, giving rise to complexes of proteins having different substrate specificities. A common property of the various protein complexes is that they interact with RNAs, protecting them against inappropriate nuclease activity and/or modifying their structures, in many cases affecting their interactions with other RNAs or with proteins. Genes encoding Lsm proteins are found not only in eukaryotes but also in bacteria and even archaebacteria, which do not have any splicing apparatus.

In yeast, Lsm proteins have been described to form complexes both in the nucleus and in the cytoplasm that affect pre-mRNA splicing and degradation, small nuclear RNA, tRNA and rRNA processing and mRNA degradation. These activities suggest RNA chaperon-like roles for the Lsm proteins affecting RNA-RNA and or RNA-Protein interactions. The nuclear Lsm proteins play additional roles in maintenance of the ordering in the pre-rRNA processing events, they associate with and possibly facilitate assembly of the ribosome. Mutations in the Lsm6p, Lsm7p and Lsm1p proteins had only a minor impact on the stability of nuclear RNAs indicating that other active Lsm or maybe Sm proteins can replace these non-essential Lsm proteins. (Beggs J D. et al. Biochem Soc Trans. 2005 June; 33(Pt 3):433-8). Therefore, despite the fact that Lsm proteins associate to form distinct protein complexes having different substrate specificity, there is functional redundancy amongst Lsm proteins allowing that alternative protein complexes with different Lsm composition to perform the same function. Functional conservation of Lsm proteins across species has been shown using heterologous systems. For example, yeast Lsm1p facilitates replication of a plant RNA virus in yeast (Noueiry A O, et al. Mol Cell Biol. 2003 June; 23(12):4094-106).

The interaction of Lsm1 with proteins involved in decapping of mRNAs suggested and additional role of Lsm proteins in cytoplasmic mRNA decay (Tharun S, et al. Genetics. 2005 May; 170(1):33-46). Additional distinct roles in protecting snoRNAs (small nucleolar RNAs) as well as snRNAs against 3' end trimming and ARE-mRNA (messenger RNAs containing an AU-rich element) degradation have also been described (Beggs JD. Lsm proteins and RNA processing. Biochem Soc Trans. 2005 June; 33 (Pt 3):433-8; Stoecklin G, Mayo T, Anderson P. ARE-mRNA degradation requires the 5'-3' decay pathway. EMBO Rep. 2006 January; 7(1):72-7). Stoecklin G, Mayo T, Anderson P. ARE-mRNA degradation requires the 5'-3' decay pathway. EMBO Rep. 2006 January; 7(1):72-7).

In yeast LSM proteins have been classified into eight classes, Lsm1 to Lsm8 (Wang and Brendel Genome Biology 2004, 5:R102). All yeast Lsm proteins have homologs in plants. In *Arabidopsis thaliana* there are 11 Lsm proteins identified falling into the same eight groups found in yeast. Four of the Lsm proteins are duplicated in *Arabidopsis*. It is likely that these genes existed as single copies in the ancestor of animals and plants, but duplicated within the plant lineage.

In plants, one of the 11 Lsm genes (LSM5, At5g48870) has been experimentally characterized. An *Arabidopsis* mutant defective in Lsm5p has been isolated and shown to play a role in the modulation of the abcisic acid signal transduction. Accordingly the mutant plants showed a SAD (supersensitive to ABA and drought treatment) phenotype (Xiong L, et al. Dev Cell. 2001 December; 1(6):771-81).

III. Truncated Cyclin H

Cyclins are proteins that play a role in the progression of the cell cycle. They are synthesised and degraded during the cell cycle and most of them exert their function by binding to and thereby activating cyclin-dependent kinases. Cyclins can be grouped into mitotic cyclins (designated A- and B-type cyclins in higher eukaryotes and CLBs in budding yeast) and G1-specific cyclins (designated D-type cyclins in mammals and CLNs in budding yeast). Cyclin B, for example, is the large protein subunit of mitosis promoting factor (MPF); cyclin B is synthesized and degraded during the cell cycle to regulate MPF activity. Cyclin B plus cyclin dependent kinase 1 (cdk1, aka cdc2, aka p34 kinase) together form an active MPF protein. Other cyclins include cyclin E (binds to G1 phase Cdk), which is required for the transition from G1 to S phase and cyclin A, which binds to S phase Cdk2 and is required for the cell to progress through the S phase. H-type cyclins regulate the activity of the CAKs (CDK-activating kinases). All four types of cyclins known in plants were identified mostly by analogy to their human counterparts. In *Arabidopsis*, ten A-type, nine B-type, ten D-type and one H-type cyclin have been described (Vandepoele et al., 2002). Cyclins typically have a so-called cyclin box, a conserved sequence required for binding to, and activation of the cyclin-dependent kinase.

Cyclin H is also a regulator of the cell cycle (Fisher et al Cell 78, 713-724, 1994; Makela et al Nature 371, 254-257, 1994; Yamaguchi et al. Plant J. 24, 11-20, 2000). In animal cells, it is part of a CDK7/cyclin H/MAT1 complex. This complex is actually a "cyclin activation complex", which regulates the activity of other cyclin/CDK complexes by phosphorylation of the cyclin, within an activation cascade. It is also involved in transcription and DNA repair. CDK7, and its counterparts in other organisms, such as R2 in rice, or Mcs6/Crk1/Mop1 in *Schizosaccharomyces*, are known as Cyclin-dependent kinase Activating Kinase (CDK-activating kinase or CAK).

The CDK-activating kinase (CAK) activates cyclin-dependent kinases (cdks) that control cell-cycle progression by phosphorylating a threonine residue conserved in cdks. The CAK complex from humans encompasses p40MO15 (cdk7), cyclin H and MAT1, which are also subunits of transcription factor IIH that phosphorylates the C-terminal domain of the large subunit of RNA polymerase II.

IV. Remorin

Remorins (also called pp 34 or dbp) form a superfamily of plasma membrane/lipid-raft associated proteins (Alliotte et al. (1989) Plant Physiol 89: 743-752; Reymond et al. (1996) Plant Cell 8: 2265-2276; Bariola et al. (2004) Plant Molec Biol 55: 579-594; Mongrand et al. (2004) J Biol Chem 279 (35): 36277-36286). This plant-specific superfamily is found in angiosperms, gymnosperms and bryophytes. At least 15 closely related Remorins polypeptides are found in *Arabidopsis*, and Remorin families in other plants are similarly abundant.

Remorin polypeptides are characterized by the presence of a coiled coil domain in their C-terminal half. Coiled coil domains are often implicated in protein-protein interaction, in particular in oligomerization. In accordance with this, Remorins have been found to oligomerize and form filamentous structures in vitro, and to exist as oligomeric structures in plant plasma membrane preparations (Bariola et al., supra).

Although strongly associated with plasma membranes, the Remorin polypeptides do not have the structure of a typical membrane-bound protein. Instead, Remorins are small hydrophilic polypeptides. In particular, the C-terminal half of Remorins is rich in charged amino acids (Lys (K) Arg (R), Asp (D), and Glu (E). Finally, a large proportion of Remorins comprise at least a cysteine (Cys, or C) and/or a phenylalanine (Phe, or F) comprised in the last ten amino acid residues at the C-terminus of the polypeptide.

Remorins can bind unspecifically with polyanions in vitro, such as oligogalacturonic acids (OGAs; Reymond et al., supra), polygalacturonic acids (PGAs; Farmer et al. (1991) J Biol Chem 266(5):3140-5), and can also bind double-stranded DNA (Alliotte et al., supra). OGAs, which are active extracellular matrix components involved in numerous signaling pathways, also stimulate phosphorylation of Remorins in vitro, primarily at threonine residues.

It has not been possible to recover healthy *Arabidopsis* lines that overexpress a nucleic acid sequence encoding a Remorin polypeptide, and antisense lines display no obvious phenotype, possible due to the fact that Remorins are represented by large multigene families (Bariola et al., supra). International patent application WO 02/16655 describes a nucleic acid sequence encoding a Remorin polypeptide as SEQ ID NO: 2621. U.S. Pat. No. 7,071,380 describes two nucleic acid sequences encoding a Remorin polypeptide as SEQ ID NO: 379 and SEQ ID NO: 380. U.S. Pat. No. 7,135,616 describes a nucleic acid sequence encoding a Remorin polypeptide as SEQ ID NO: 133.

V. DREB

Transcription factors are usually defined as proteins that show sequence-specific DNA binding and that are capable of activating and/or repressing transcription. The *Arabidopsis* genome encodes for at least 1533 transcriptional regulators, which account for ~5.9% of its estimated total number of genes. About 45% of these transcription factors are reported to be from families specific to plants (Riechmann et al., 2000 (Science Vol. 290, 2105-2109)).

The AP2/EREBPs (APETALA2/Ethylene-Responsive Element Binding Proteins) are the prototypic family of transcription factors unique to plants whose distinguishing characteristic is that they contain a so-called AP2 DNA-binding domain, which interacts directly with a GCC box in the ethylene responsive promoters. Nonetheless proteins containing an AP2 domain are also encoded in the genome of viruses, cyanobacteria and ciliates, where they are thought to function as endonucleases (Magnani et al. Plant Cell. 2004 September; 16(9):2265-77).

The AP2/EREBP family members are classified into three different groups based on the number of AP2 domains and the presence of other conserved motifs. The consensus sequence of the AP2 domain shows slight differences amongst groups. The first distinct group, named APETALA 2 subfamily, is composed of members containing two repeated AP2 domains. Members of the second group, named ERF subfamily, contain a single AP2 domain, and the third group, also referred to as RAV proteins, is composed of proteins containing a B3 domain in addition to a single AP2 domain. While proteins with two AP2 domains have been reportedly shown to play a developmental role, most of the single AP2 domain containing proteins have been studied in relation to biotic and abiotic stress.

The DREBs or CBFs proteins constitute a subgroup of single AP2 domain containing proteins involved in responsiveness to abiotic stress (Yamaguchi-Shinozaki, et al. 1994. Plant Cell 6, 251-264). The DREBs or CBFs have been reported to bind specific cis-acting elements in gene promoters named DRE (drought-responsive element) and/or CRT (C-repeat) and to activate the transcription of the downstream genes related to cold, drought, and high salinity (Baker, et al.

(1994) Plant Mol. Biol. 24, 710-713); Stockinger, et al. (1997) Proc. Natl. Acad. Sci. 94, 1035-1040; Liu, et al. Plant Cell 10, 1391-1406).

Gene expression of DREB proteins is highly regulated in plants. According to differential expression under different stress conditions, two subgroups of DREBS can be distinguished in *Arabidopsis*, DREB1 and DREB2. However, structurally and functionally the two subgroups operate similarly by binding to the DRE/CRT cis elements and regulating expression of stress genes. In addition, the binding can result in trans-activation or trans-inactivation of downstream genes (Zhao, et al 2006, JBC 218, 10752-10759).

Overexpression of DREB genes in plants has widely been reported to result in strong expression of stress-inducible genes, and the transgenic plants acquired higher tolerance to abiotic stresses (Jaglo-Ottosen et al. (1998) Science 280:104-106; Sakuma Y, et al. (2006) Plant Cell 18:1292-1309; Jaglo K R, et al. (2001). Plant Physiol 127:910-917; Shen et al. (2003) Theor Appl Genet. 106:923-930, Dubouzet J G, et al. (2003) Plant J 33:751-763). Abiotic stress tolerance has also been reported for a CBF2 mutant in *Arabidopsis thaliana* impaired in CBF2 gene expression. Interestingly, the expression levels of CBF1/DREB1B and CBF3/DREB1A in the CBF2 knock out plants were increased. These results suggested that in *Arabidopsis* the CBF2/DREB1C negatively regulates expression of CBF1/DREB1B and CBF3/DREB1A genes (Novillo et al. 2004, 101, 3985-3990).

Surprisingly, it has now been found that modulating expression in a plant of a nucleic acid encoding a Yield Enhancing Polypeptide (YEP) selected from a Nucleosome Assembly Protein 1-like polypeptide (NAP1-like), a Like Sm polypeptide (Lsm protein), a truncated Cyclin H (CycH$_{Tr}$) polypeptide, a Remorin polypeptide, and a DREB protein, gives plants having enhanced yield-related traits and/or increased abiotic stress resistance relative to control plants.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |

TABLE 1-continued

Examples of conserved amino acid substitutions

| Residue | Conservative Substitutions |
|---|---|
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Ortholoque(s)/Paraloque(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA Hybrids (Meinkoth and Wahl, Anal. Biochem., 138: 267-284, 1984):

$$T_m = 81.5°C + 16.6 \times \log_{10}[Na^+]^a + 0.41 \times \% [G/C^b] - 500 \times [L^c]^{-1} - 0.61 \times \% \text{ formamide}$$

2) DNA-RNA or RNA-RNA Hybrids:

$$T_m = 79.8 + 18.5(\log_{10}[Na^+]^a) + 0.58(\% G/C^b) + 11.8(\% G/C^b)^2 - 820/L^c$$

3) Oligo-DNA or Oligo-RNA Hybrids:
   For <20 nucleotides: $T_m = 2(l_n)$
   For 20-35 nucleotides: $T_m = 22 + 1.46(l_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $l_n$=effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (IN-DELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about $1/10,000$ transcripts to about $1/100,000$ transcripts, to about $1/500,0000$ transcripts per cell. Conversely, a "strong promoter" drives expression of a coding sequence at high level, or at about $1/10$ transcripts to about $1/100$ transcripts to about $1/1000$ transcripts per cell.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2 (6): 837-44, 1992, WO 2004/065596 |
| Ubiquitin | Christensen et al, Plant Mol. Biol. 18: 675-689, 1992 |

TABLE 2a-continued

Examples of constitutive promoters

| Gene Source | Reference |
| --- | --- |
| Rice cyclophilin | Buchholz et al, Plant Mol Biol. 25 (5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85 (5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12 (20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters are shown in Table 2b, 2c, 2d and 2e below. Further examples of seed-specific promoters are given in Qing Qu and Takaiwa (Plant Biotechnol. J. 2, 113-125, 2004), which disclosure is incorporated by reference herein as if fully set forth.

TABLE 2b

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14 (3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat $\alpha$, $\beta$, $\gamma$-gliadins | EMBO J. 3: 1409-15, 1984 |
| barley ltr1 promoter | Diaz et al. (1995) Mol Gen Genet 248 (5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116 (1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39 (8) 885-889, 1998 |
| rice a-globulin Glb-1 | Wu et al, Plant Cell Physiology 39 (8) 885-889, 1998 |
| rice OSH1 | Sato et al, Proc. Natl. Acad. Sci. USA, 93: 8117-8122, 1996 |
| rice $\alpha$-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum $\alpha$-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| $\alpha$-amylase (Amy32b) | Lanahan et al, Plant Cell 4: 203-211, 1992; Skriver et al, Proc Natl Acad Sci USA 88: 7266-7270, 1991 |
| cathepsin $\beta$-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2c examples of endosperm-specific promoters

| Gene source | Reference |
| --- | --- |
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14 (3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley ltr1 promoter | Diaz et al. (1995) Mol Gen Genet 248 (5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al. (1998) Plant J 116 (1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39 (8) 885-889 |
| rice globulin Glb-1 | Wu et al. (1998) Plant Cell Physiol 39 (8) 885-889 |

TABLE 2c-continued examples of endosperm-specific promoters

| Gene source | Reference |
| --- | --- |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2d

Examples of embryo specific promoters:

| Gene source | Reference |
| --- | --- |
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2e

Examples of aleurone-specific promoters:

| Gene source | Reference |
| --- | --- |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Another example of a tissue-specific promoter is a meristem-specific promoter, which is transcriptionally active predominantly in meristematic tissue, substantially to the exclusion of any other parts of a plant, whilst still allowing for any leaky expression in these other plant parts.

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F.F.

White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent AF (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome.

These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

I. NAP

According to a first embodiment, the present invention provides a method for increasing abiotic stress tolerance in plants relative to control plants, comprising modulating expression in a plant of a nucleic acid encoding a NAP1-like polypeptide.

A preferred method for modulating (preferably, increasing) expression of a nucleic acid encoding a NAP1-like polypeptide is by introducing and expressing in a plant a nucleic acid encoding a NAP1-like polypeptide.

Any reference hereinafter to a "protein useful in the methods of the invention" is taken to mean a NAP1-like polypeptide as defined herein. Any reference hereinafter to a "nucleic acid useful in the methods of the invention" is taken to mean a nucleic acid capable of encoding such a NAP1-like polypeptide. The nucleic acid to be introduced into a plant (and therefore useful in performing the methods of the invention) is any nucleic acid encoding the type of protein which will now be described, hereafter also named "NAP1-like nucleic acid" or "NAP1-like gene".

The term "NAP1-like protein" as defined herein refers to any protein comprising a NAP domain and an acidic C-terminal region. The term "NAP domain" as used herein is as defined in the Pfam database by accession number PF00956 (database hosted by the Sanger Institute, UK; Bateman et al., Nucleic Acids Research 30(1):276-280 (2002), see for example Table 3). Preferably, NAP1-like protein sequences useful in the present invention have a NAP domain comprising a (T/S)FF(T/N/S/E/D)(W/F)(L/F) signature (SEQ ID NO: 33) and/or the conserved amino acid sequence as given in SEQ ID NO: 34. Preferably, the signature of SEQ ID NO: 33 is SFF(T/N/S)(W/F)F. Preferably the NAP domain of a NAP1-like protein useful in the methods of the present invention has increasing order of preference at least 20%, 25%, 30%, 35%, 40%, 45% sequence identity with SEQ ID NO: 32. More preferably, the NAP domain of a NAP1-like protein useful in the methods of the present invention has at least, in increasing order of preference, 50%, 55%, 60%, 65%, 70%, 75%, 80%, 85%, 90%, 95%, 96%, 97%, 98%, 99% sequence identity with SEQ ID NO: 32. Most preferably, the NAP domain is as represented by SEQ ID NO: 32. The term "acidic C-terminal region" or "acidic C-terminus" as used herein refers to the carboxy-terminal end of the protein, which carboxy-terminal end is about 20 to 25 amino acids long, of which at least 13 residues are glutamic and/or aspartic acid.

TABLE 3

Examples of *Arabidopsis* proteins comprising a NAP1 domain

| Gene ID | Pfam profile | Position | Score | e-value | SEQ ID NO: |
|---|---|---|---|---|---|
| at1g18800 | PF00956 | 27-224 | 147.7 | 2e−40 | 20, 21 |
| at1g74560 | PF00956 | 31-229 | 135.0 | 1.3e−36 | 1, 2 |
| at2g19480 | PF00956 | 52-300 | 457.4 | 1.2e−133 | 26, 27 |
| at5g56950 | PF00956 | 52-300 | 473.2 | 2.2e−138 | 28, 29 |
| at4g26110 | PF00956 | 52-301 | 503.4 | 1.7e−147 | 24, 25 |
| at3g13782 | PF00956 | 69-311 | 300.7 | 1.7e−86 | 30, 31 |

Furthermore, NAP1-like polypeptides (at least in their native form) have PP2a phosphatase inhibiting activity. Tools and techniques for measuring PP2a phosphatase inhibiting activity are well known in the art, see for example Li et al, J. Biol. Chem. 271, 11059-11062, and references therein. Chromatin remodelling activities may be assayed in several ways, such as measurement of DNA-binding activity in a gel retardation assay (Fan et al., 2002) or as measurement of histone-binding activity using ELISA (Rodriguez et al. (1997) Genomics 44, 253-265). DNA bending activity may be determined in a ligase-mediated circularization assay (Fan et al., 2002) or in a supercoiling assay (Fujii-Nakata et al. (1992) J. Biol. Chem. 267, 20980-20986; Yoon et al. (1995), Mol. Gen. Gen. 249, 465-473). Further guidance for characterising NAP1-like proteins is provided in Example 6.

Preferably, the polypeptide sequence which when used in the construction of a phylogenetic tree, such as the one depicted in FIG. 4, clusters with the group of NAP1-like polypeptides comprising the amino acid sequence represented by SEQ ID NO: 2 rather than with any other group.

The terms "domain" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). Domains may also be identified using routine techniques, such as by sequence alignment.

Analysis of the polypeptide sequence of SEQ ID NO: 2 in the SMART database, revealed there to be an NAP domain (PFAM entry PF0059, FIG. 1). This domain is specific for NAP proteins, which are postulated to be involved in moving histones into the nucleus, nucleosome assembly and chromatin fluidity. By aligning the sequence of SEQ ID NO: 2 with sequences of other NAP1-like proteins, the localisation of the NAP domain may be determined.

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. For local alignments, the Smith-Waterman algorithm is particularly useful (Smith T F, Waterman M S (1981) J. Mol. Biol. 147(1); 195-7). The sequence identity values, which are indicated below in Example 3 as a percentage were determined over the entire nucleic acid or amino acid sequence, and/or over selected domains or conserved motif(s), using the programs mentioned above using the default parameters.

The present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any NAP1-like-encoding nucleic acid or NAP1-like polypeptides as defined herein.

Examples of nucleic acids encoding NAP1-like polypeptides are given in Table A of Example 1 herein. Such nucleic acids are useful in performing the methods of the invention. The amino acid sequences given in Table A of Example 1 are example sequences of orthologues and paralogues of the NAP1-like polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A of Example 1, the terms "homologue" and "derivative" being as defined herein. Also useful in the methods of the invention are nucleic acids encoding homologues and derivatives of orthologues or paralogues of any one of the amino acid sequences given in Table A of Example 1. Homologues and derivatives useful in the methods of the present invention have substantially the same biological and functional activity as the unmodified protein from which they are derived.

Further nucleic acid variants useful in practising the methods of the invention include portions of nucleic acids encoding NAP1-like polypeptides, nucleic acids hybridising to nucleic acids encoding NAP1-like polypeptides, splice variants of nucleic acids encoding NAP1-like polypeptides, allelic variants of nucleic acids encoding NAP1-like polypeptides and variants of nucleic acids encoding NAP1-like polypeptides obtained by gene shuffling. The terms hybridising sequence, splice variant, allelic variant and gene shuffling are as described herein.

Nucleic acids encoding NAP1-like polypeptides need not be full-length nucleic acids, since performance of the methods of the invention does not rely on the use of full-length nucleic acid sequences. According to the present invention, there is provided a method for increasing abiotic stress resistance in plants, comprising introducing and expressing in a plant a portion of any one of the nucleic acid sequences given in Table A of Example 1, or a portion of a nucleic acid encoding an orthologue, paralogue or homologue of any of the amino acid sequences given in Table A of Example 1.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a NAP1-like polypeptide as defined herein, and have substantially the same biological activity as the amino acid sequences given in Table A of Example 1. Preferably, the portion is a portion of any one of the nucleic acids given in Table A of Example 1, or is a portion of a nucleic acid encoding an orthologue or paralogue of any one of the amino acid sequences given in Table A of Example 1. Preferably the portion is, in increasing order of preference at least 400, 500, 600 or 700 consecutive nucleotides in length, the consecutive nucleotides being of any one of the nucleic acid sequences given in Table A of Example 1, or of a nucleic acid encoding an orthologue or paralogue of any one of the amino acid sequences given in Table A of Example 1. Most preferably the portion is a portion of the nucleic acid of SEQ ID NO: 1. Preferably, the portion encodes an amino acid sequence comprising (any one or more of the domains or motifs defined herein). Preferably, the portion encodes an amino acid sequence which, when used in the construction of a phylogenetic tree, tends to cluster with the group of NAP1-like polypeptides comprising the amino acid sequence represented by SEQ ID NO: 2 rather than with any other group.

Another nucleic acid variant useful in the methods of the invention is a nucleic acid capable of hybridising, under reduced stringency conditions, preferably under stringent conditions, with a nucleic acid encoding a NAP1-like polypeptide as defined herein, or with a portion as defined herein.

According to the present invention, there is provided a method for increasing abiotic stress resistance of plants, comprising introducing and expressing in a plant a nucleic acid capable of hybridizing to any one of the nucleic acids given in Table A of Example 1, or comprising introducing and expressing in a plant a nucleic acid capable of hybridising to a nucleic acid encoding an orthologue, paralogue or homologue of any of the nucleic acid sequences given in Table A of Example 1.

Hybridising sequences useful in the methods of the invention encode a NAP1-like polypeptide as defined herein, and have substantially the same biological activity as the amino acid sequences given in Table A of Example 1. Preferably, the hybridising sequence is capable of hybridising to any one of the nucleic acids given in Table A of Example 1, or to a portion of any of these sequences, a portion being as defined above, or wherein the hybridising sequence is capable of hybridising to a nucleic acid encoding an orthologue or paralogue of any one of the amino acid sequences given in Table A of Example 1. Most preferably, the hybridising sequence is capable of hybridising to a nucleic acid as represented by SEQ ID NO: 1 or to a portion thereof. Preferably, the hybridising sequence encodes an amino acid sequence comprising any one or more of the motifs or domains as defined herein. Preferably, the hybridising sequence encodes an amino acid sequence which, when used in the construction of a phylogenetic tree, tends to cluster with the group of NAP1-like polypeptides comprising the amino acid sequence represented by SEQ ID NO: 2 rather than with any other group.

Another nucleic acid variant useful in the methods of the invention is a splice variant encoding a NAP1-like polypeptide as defined hereinabove, a splice variant being as defined herein.

According to the present invention, there is provided a method for increasing abiotic stress resistance of plants, comprising introducing and expressing in a plant a splice variant of any one of the nucleic acid sequences given in Table A of Example 1, or a splice variant of a nucleic acid encoding an orthologue, paralogue or homologue of any of the amino acid sequences given in Table A of Example 1.

Preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant comprises any one or more of the motifs or domains as defined herein. Preferably, the amino acid sequence encoded by the splice variant, when used in the construction of a phylogenetic tree, tends to cluster with the group of NAP1-like polypeptides comprising the amino acid sequence represented by SEQ ID NO: 2 rather than with any other group.

Another nucleic acid variant useful in performing the methods of the invention is an allelic variant of a nucleic acid encoding a NAP1-like polypeptide as defined hereinabove, an allelic variant being as defined herein.

According to the present invention, there is provided a method for increasing abiotic stress resistance of plants, comprising introducing and expressing in a plant an allelic variant of any one of the nucleic acids given in Table A of Example 1, or comprising introducing and expressing in a plant an allelic variant of a nucleic acid encoding an orthologue, paralogue or homologue of any of the amino acid sequences given in Table A of Example 1.

The allelic variants useful in the methods of the present invention have substantially the same biological activity as the NAP1-like polypeptide of SEQ ID NO: 2 and any of the amino acids depicted in Table A of Example 1. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid encoded by the allelic variant comprises any one or more of the motifs or domains as defined herein. Preferably, the amino acid sequence encoded by the allelic variant, when used in the construction of a phylogenetic tree, tends to cluster with the group of NAP1-like polypeptides comprising the amino acid sequence represented by SEQ ID NO: 2 rather than with any other group.

Gene shuffling or directed evolution may also be used to generate variants of nucleic acids encoding NAP1-like polypeptides as defined above; the term "gene shuffling" being as defined herein.

According to the present invention, there is provided a method for increasing abiotic stress resistance of plants, comprising introducing and expressing in a plant a variant of any one of the nucleic acid sequences given in Table A of Example 1, or comprising introducing and expressing in a plant a variant of a nucleic acid encoding an orthologue, paralogue or homologue of any of the amino acid sequences given in Table A of Example 1, which variant nucleic acid is obtained by gene shuffling.

Preferably, the variant nucleic acid obtained by gene shuffling encodes an amino acid sequence comprising any one or more of the motifs or domains as defined herein. Preferably, the amino acid sequence encoded by the variant nucleic acid obtained by gene shuffling, when used in the construction of a phylogenetic tree, tends to cluster with the group of NAP1-like polypeptides comprising the amino acid sequence represented by SEQ ID NO: 2 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding NAP1-like polypeptides may be derived from any natural or artificial source. The nucleic acid may be modified from its native form in composition and/or genomic environment through deliberate human manipulation. Preferably the NAP1-like polypeptide-encoding nucleic acid is from a plant, further preferably from a monocotyledonous plant, more preferably from the family Brassicaceae, more preferably from the genus *Arabidopsis*, most preferably from *Arabidopsis thaliana*.

Performance of the methods of the invention gives plants having increased abiotic stress resistance (or abiotic stress tolerance, which terms are used interchangeably), effected as enhanced yield-related traits compared to control plants when grown under abiotic stress. In particular, performance of the methods of the invention gives plants having increased yield, especially increased seed yield relative to control plants. The terms "yield" and "seed yield" are described in more detail in the "definitions" section herein. However it should be noted that the term "yield-related traits" does not encompass the metabolite content of plant cells and that the enhanced yield-related traits are the result of increased stress resistance.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of suitable control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing abiotic stress resistance of plants, resulting in increased yield, especially seed yield of plants, relative to control plants, when grown under conditions of abiotic stress, which method comprises modulating expression, preferably increasing expression, in a plant of a nucleic acid encoding a NAP1-like polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle. Besides the increased yield capacity, an increased efficiency of nutrient uptake may also contribute to the increase in yield. It is observed that the plants according to the present invention show a higher efficiency in nutrient uptake. Increased efficiency of nutrient uptake allows better growth of the plant, when the plant is under stress.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants when grown under abiotic stress conditions. Therefore, according to the present invention, there is provided a method for increasing the growth rate of plants under abiotic stress conditions, which method comprises modulating expression, preferably increasing expression, in a plant of a nucleic acid encoding a NAP1-like polypeptide as defined herein.

An increase in yield and/or growth rate occurs when the plant is exposed to various abiotic stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses (as used herein) are the everyday abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with an increased yield when grown under nitrogen-limiting conditions.

Biotic stresses are typically those stresses caused by pathogens, such as bacteria, viruses, nematodes, fungi and insects.

In particular, the methods of the present invention may be performed under stress conditions to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse abiotic stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under abiotic stress conditions increased yield relative to suitable control plants grown under comparable conditions. Therefore, according to the present invention, there is provided a method for increasing yield in plants grown under abiotic stress conditions, which method comprises increasing expression in a plant of a nucleic acid encoding a NAP1-like polypeptide. In a particular embodiment, the increased abiotic stress tolerance is increased tolerance to reduced availability of nutrients.

The present invention encompasses plants or parts thereof (including seeds) obtainable by the methods according to the present invention. The plants or parts thereof comprise a nucleic acid transgene encoding a NAP1-like polypeptide as defined above.

The invention also provides genetic constructs and vectors to facilitate introduction and/or expression in plants of nucleic acids encoding NAP1-like polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
 (a) a nucleic acid encoding a NAP1-like polypeptide as defined above;
 (b) one or more control sequences capable of driving expression of the nucleic acid sequence of (a); and optionally
 (c) a transcription termination sequence.

Preferably, the nucleic acid encoding a NAP1-like polypeptide is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. A constitutive promoter is particularly useful in the methods of the invention, preferably the constitutive promoter is a strong constitutive promoters. It should be clear that the applicability of the present invention is not restricted to the NAP1-like polypeptide-encoding nucleic acid represented by SEQ ID NO: 1, nor is the applicability of the invention restricted to expression of a NAP1-like polypeptide-encoding nucleic acid when driven by a constitutive promoter.

The constitutive promoter is preferably a GOS2 promoter, more preferably the rice GOS2 promoter, most preferably the promoter as represented in SEQ ID NO: 39. See Table 2 in the "Definitions" section herein for further examples of constitutive promoters. Preferably the construct comprises an expression cassette as represented by SEQ ID NO: 3.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol, described in the definitions section.

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

The invention also provides a method for the production of transgenic plants having enhanced yield-related traits relative to control plants, when grown under abiotic stress conditions, comprising introduction and expression in a plant of any nucleic acid encoding a NAP1-like polypeptide as defined hereinabove.

More specifically, the present invention provides a method for the production of transgenic plants having increased yield, which method comprises:
 (i) introducing and expressing in a plant or plant cell a NAP1-like polypeptide-encoding nucleic acid; and
 (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a NAP1-like polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Increased expression or overexpression is to be understood as any expression that is additional to the original wild-type expression level. Methods for increasing expression of nucleic acids or genes, or gene products, are well documented in the art and examples are provided in the definitions section.

As mentioned above, a preferred method for modulating (preferably, increasing) expression of a nucleic acid encoding a NAP1-like polypeptide is by introducing and expressing in a plant a nucleic acid encoding a NAP1-like polypeptide; however the effects of performing the method, i.e. enhancing yield-related traits may also be achieved using other well known techniques. A description of some of these techniques will now follow.

One such technique is T-DNA activation tagging (Hayashi et al. Science (1992) 1350-1353), which involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

The effects of the invention may also be reproduced using the technique of TILLING (Targeted Induced Local Lesions In Genomes); for a description of the same see the "definitions" section.

The effects of the invention may also be reproduced using homologous recombination; for a description of the same see the "definitions" section.

The present invention also encompasses use of nucleic acids encoding NAP1-like polypeptides as described herein and use of this NAP1-like polypeptide in enhancing any of the aforementioned yield-related traits in plants when grown under abiotic stress conditions.

Nucleic acids encoding a NAP1-like polypeptide described herein, or the NAP1-like polypeptides themselves, may find use in breeding programmes in which a DNA marker is identified which may be genetically linked to a NAP1-like polypeptide-encoding gene. The nucleic acids/genes, or the NAP1-like polypeptides themselves may be used to define a molecular marker. This DNA or protein marker may then be used in breeding programmes to select plants having enhanced yield-related traits as defined hereinabove in the methods of the invention.

Allelic variants of a NAP1-like polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding NAP1-like polypeptides may also be used as probes for genetically and physically mapping the genes that they are a part of, and as markers for traits linked to those genes. Such information may be useful in plant breeding in order to develop lines with desired phenotypes. Such use of NAP1-like polypeptide-encoding nucleic acids requires only a nucleic acid sequence of at least 15 nucleotides in length. The NAP1-like polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the NAP1-like-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the NAP1-like polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

II. Lsm

Surprisingly, it has now been found that modulating expression in a plant of a nucleic acid encoding an Lsm polypeptide gives plants having enhanced yield-related traits relative to control plants. The particular class of Lsm polypeptides suitable for enhancing yield-related traits in plants is described in detail below.

The present invention provides a method for enhancing yield-related traits in plants relative to control plants, comprising modulating expression in a plant of a nucleic acid encoding an Lsm polypeptide.

Any reference hereinafter to a "protein useful in the methods of the invention" is taken to mean an Lsm polypeptide as defined herein. Any reference hereinafter to a "nucleic acid useful in the methods of the invention" is taken to mean a nucleic acid capable of encoding such an Lsm polypeptide.

A preferred method for modulating (preferably, increasing) expression of a nucleic acid encoding a protein useful in the methods of the invention is by introducing and expressing in a plant a nucleic acid encoding a protein useful in the methods of the invention as defined below.

The nucleic acid to be introduced into a plant (and therefore useful in performing the methods of the invention) is any nucleic acid encoding the type of protein, which will now be described, hereafter also named "Lsm nucleic acid" or "Lsm gene". A "Lsm" polypeptide as defined herein refers to any molecule with an amino acid sequence comprising an Lsm domain. SEQ ID Nos 120, 121, 122, 123, 124, 125, 126, 127, 128, 129 and 130 are examples of Lsm domains found in the representative Lsm proteins as provided in SEQ ID Nos 41, 43, 45, 47, 49, 51, 53, 55, 57, 59, and 61. Typically, the Lsm domain in Lsm proteins have an amino acid sequence in increasing order of preference, at least 50%, 60%, 70%, 75%, 80%, 85%, 90%, 95%, 96%, 97%, 98%, 99% or 100% sequence identity to a sequence selected from SEQ ID Nos 120, 121, 122, 123, 124, 125, 126, 127, 128, 129 and 130.

The presence of Lsm domains in a polypeptide can be readily determined by comparing the sequence to already well-described Lsm proteins and establishing homology in the Lsm domain. Methods to perform sequence comparison are well known in the art and described hereafter. Alternative, Lsm domains can be readily identified by searching in appropriate databases containing conserved protein domains as described in Example 14.

Typically, Lsm proteins comprise an amino acid sequence having in increasing order of preference at least 50%, 60%, 70%, 75%, 80%, 85%, 90%, 95%, 96%, 97%, 98%, 99% or 100% sequence identity to a sequence selected from a group of SEQ ID Nos 41, 43, 45, 47, 49, 51, 53, 55, 57, 59, and 61.

Further preferably the Lsm sequence of the protein useful in the methods of the invention comprises any one or more of the following conserved motifs:

Motif I: GTLXSFDQFANVVLXGACERVIVGELY-CDVPLGLYVIRGENVVLIG, or a motif having in increasing order of preference at least 70%, 80% or 90% sequence identity to the sequence of Motif I, where any conservative change is allowed and where 'X' is taken to be any amino acid.

Motif II: KAEREARDLKGTMRKRMEFLDFD, or a motif having in increasing order of preference at least 70%, 80% or 90% sequence identity to the sequence of Motif II, where any conservative change is allowed and where 'X' is taken to be any amino acid.

Motif I and/or Motif II may comprise in order of preference a deletion and/or a substitution and/or an insertion of 0, 1, 2, 3, 4, 5, 6 or 7 amino acids.

Further preferably the Lsm protein useful in the methods of the invention is an Lsm1 class protein. Lsm1 class protein as referred herein is any orthologue of the yeast *Saccharomyces cerevisie* Lsm1 protein or any orthologue of the *Arabidopsis thalianan* Lsm1a or Lsm1b proteins as provided in SEQ ID No. 41 and in SEQ ID No. 43.

Methods to identify orthologous proteins are well known in the art and described herein. Examples of representative Lsm1 class proteins are given in Table G.

The Lsm proteins useful in the methods of the invention preferably comprises an Lsm domain having an amino acid sequence in increasing order of preference of at least 70%, 75%, 80%, 85%, 90%, 95%, 96%, 97%, 98%, 99% or 100% sequence identity to a sequence selected from a group of SEQ ID Nos. 120, 121, 131, 132, 133, 140, 142, 143, 144, 152, 154 and 157.

Even more preferably the above mentioned Lsm1 class protein comprises an amino acid sequence having in increasing order of preference 70%, 75%, 80%, 82%, 84%, 86%, 88%, 90%, 92%, 94%, 96%, 98%, or 99% sequence identity to any of SEQ ID No 41, 43, 73, 75, 77, 81, 85, 87, 89, 105, 109 and 115. Most preferably the Lsm1 protein is any of SEQ ID No 41, 43, 73, 75, 77, 81, 85, 87, 89, 105, 109 and 115.

Examples of proteins useful in the methods of the invention and nucleic acids encoding the same are as given below in Table G of Example 11.

Also useful in the methods of the invention are homologues of any one of the Lsm amino acid sequences given in Table G of Example 11.

Also useful in the methods of the invention are derivatives of any one of the polypeptides given in Table G of Example 11 or orthologues or paralogues of any of the aforementioned SEQ ID NOs.

The invention is illustrated by transforming plants with the *Arabidopsis thaliana* nucleic acid sequence represented by SEQ ID NO: 40, encoding the polypeptide sequence of SEQ ID NO: 41, however performance of the invention is not restricted to these sequences. The methods of the invention may advantageously be performed using any nucleic acid encoding a protein useful in the methods of the invention as defined herein, including homologues, orthologues and paralogues, such as any of the nucleic acid sequences given in Table G of Example 11.

The amino acid sequences given in Table G of Example 11 may be considered to be orthologues and paralogues of the Lsm polypeptide represented by any of SEQ ID Nos 41, 43, 45, 47, 49, 51, 53, 55, 57, 59, and 61, the terms "orthologues" and "paralogues" being as defined herein.

Orthologues and paralogues may easily be found by performing a so-called reciprocal blast search. Typically, this involves a first BLAST involving BLASTing a query sequence (for example using any of the sequences listed in Table G of Example 11) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 40 or SEQ ID NO: 41, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence among highest hit; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Table G of Example 11 gives examples of orthologues and paralogues of the Lsm protein represented by SEQ ID NO 41. Further orthologues and paralogues may readily be identified using the BLAST procedure described above.

The proteins of the invention are identifiable by the presence of a conserved Lsm domain(s) (for example as shown in FIG. 9).

Preferably, the polypeptide sequence which when used in the construction of a phylogenetic tree, such as the one depicted in FIG. 9, clusters with the group of Lsm polypeptides comprising the amino acid sequence represented by SEQ ID NO: 41 rather than with any other group.

The terms "domain", "signature" and "motif" is defined in the "definitions" section herein. Specialist databases also exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)).

Domains may also be identified using routine techniques, such as by sequence alignment. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains (such as the Lsm domain, or one of the motifs defined above) may be used as well. For local alignments, the Smith-Waterman algorithm is particularly useful (Smith T F, Waterman M S (1981) J. Mol. Biol. 147(1); 195-7). The sequence identity values, which are indicated below in Example 13 as a percentage were determined over the entire nucleic acid or amino acid sequence, and/or over selected domains or conserved motif(s), using the programs mentioned above using the default parameters.

Furthermore, activity of Lsm proteins (at least in their native form) has been described. Activity assays are typically based on biochemical or biological functions of the Lsm protein properties including their ability to bind other LSM proteins, to regulate splicing, cytoplasmic mRNA decay, rRNA processing and their role in translation efficiency. Yeast two hybrid and in vitro co-precipitation experiments maybe used to detect binding to snRNA and snRNPs (Mayes A E, et al. EMBO J. 1999 Aug. 2; 18(15):4321-31). Interference with protein translation due to Lsm proteins have been reported using toeprinting, in vitro translation and electromobility shift assays (Vytvytska O, et al. Genes Dev. 2000 May 1; 14(9):1109-18; Zaric B, et al. J Biol. Chem. 2005 Apr. 22; 280(16):16066-75). Lsm activity has also been revealed by determination of relative levels of accumulation of specific genes affected by deadenylation dependent decapping (Tharum et al. 2005) or by changes in global mRNA gene expression (Fraser M M, Watson P M, Fraig M M, Kelley J R, Nelson P S, Boylan A M, Cole D J, Watson D K. CaSm-mediated cellular transformation is associated with altered gene expression and messenger RNA stability. Cancer Res. 2005 Jul. 15; 65(14):6228-36).

Nucleic acids encoding proteins useful in the methods of the invention need not be full-length nucleic acids, since performance of the methods of the invention does not rely on the use of full-length nucleic acid sequences. Examples of nucleic acids suitable for use in performing the methods of the invention include the nucleic acid sequences given in Table G of Example 11, but are not limited to those sequences. Nucleic acid variants may also be useful in practising the methods of the invention. Examples of such nucleic acid variants include portions of nucleic acids encoding a protein useful in the methods of the invention, nucleic acids hybridising to nucleic acids encoding a protein useful in the methods of the invention, splice variants of nucleic acids encoding a protein useful in the methods of the invention, allelic variants of nucleic acids encoding a protein useful in the methods of the invention and variants of nucleic acids encoding a protein useful in the methods of the invention that are obtained by gene shuffling. The terms hybridising sequence, splice variant, allelic variant and gene shuffling are as described herein.

According to the present invention, there is provided a method for enhancing yield-related traits in plants, comprising introducing and expressing in a plant a portion of any one of the nucleic acid sequences given in Table G of Example 11, or a portion of a nucleic acid encoding an orthologue, paralogue or homologue of any of the amino acid sequences given in Table G of Example 11.

Preferably the nucleic acid useful in the methods of the invention comprises any of:
  (i) SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, and SEQ ID NO: 116;
  (ii) a nucleic acid encoding an Lsm protein having, in increasing order of preference, at least 80%, 85%, 90%, 95%, 96%, 97%, 98%, 99% or 100% sequence identity to any one of the amino acid sequences given in SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117;
  (iii) a nucleic acid capable of hybridizing under stringent conditions to any one of the nucleic acids given in (i) or (ii) above.

Portions useful in the methods of the invention, encode a polypeptide falling within the definition of a nucleic acid encoding a protein useful in the methods of the invention as defined herein and having substantially the same biological activity as the amino acid sequences given in Table G of Example 11. Preferably, the portion is a portion of any one of the nucleic acids given in Table G of Example 11. The portion is typically at least 100 consecutive nucleotides in length, preferably at least 150 consecutive nucleotides in length, more preferably at least 180 consecutive nucleotides in length and most preferably at least 350 consecutive nucleotides in length, the consecutive nucleotides being of any one of the nucleic acid sequences given in Table G of Example 11. Most preferably the portion is a portion of the nucleic acid of SEQ ID NO: 40. Preferably, the portion encodes an amino acid sequence comprising any one or more of Lsm domain as defined herein. Preferably, the portion encodes an amino acid sequence which when used in the construction of an Lsm phylogenetic tree, such as the one depicted in FIG. 10, tends to cluster with any of the representative Lsm proteins comprising the amino acid sequence represented by SEQ ID Nos 41, 43, 45, 47, 49, 51, 53, 55, 57, 59, and 61 rather than clustering apart from the aforementioned SEQ ID Nos.

A portion of a nucleic acid encoding an Lsm protein as defined herein may be prepared, for example, by making one or more deletions to the nucleic acid. The portions may be used in isolated form or they may be fused to other coding (or non coding) sequences in order to, for example, produce a protein that combines several activities. When fused to other coding sequences, the resultant polypeptide produced upon translation may be bigger than that predicted for the Lsm protein portion.

Another nucleic acid variant useful in the methods of the invention is a nucleic acid capable of hybridising, under reduced stringency conditions, preferably under stringent conditions, with a nucleic acid encoding an Lsm protein as defined herein, or with a portion as defined herein.

Hybridising sequences useful in the methods of the invention, encode a polypeptide having an Lsm domain (see the alignment of FIG. 10) and having substantially the same biological activity as the Lsm protein represented by any of the amino acid sequences given in Table G of Example 11. The hybridising sequence is typically at least 100 consecutive nucleotides in length, preferably at least 150 consecutive nucleotides in length, more preferably at least 180 consecutive nucleotides in length and most preferably at least 350 consecutive nucleotides in length, the consecutive nucleotides being of any one of the nucleic acid sequences given in Table G of Example 11. Preferably, the hybridising sequence is one that is capable of hybridising to any of the nucleic acids given in Table G of Example 11, or to a portion of any of these sequences, a portion being as defined above. Most preferably, the hybridising sequence is capable of hybridising to a nucleic acid as represented by SEQ ID NO: 40 or to a portion thereof. Preferably, the hybridising sequence encodes an amino acid sequence comprising any one or more of the motifs or domains as defined herein. Preferably, the hybridising sequence encodes an amino acid sequence which when used in the construction of an Lsm phylogenetic tree, such as the one depicted in FIG. 10, tends to cluster with any of the representative Lsm proteins comprising the amino acid sequence represented by SEQ ID Nos 41, 43, 45, 47, 49, 51, 53, 55, 57, 59, and 61 rather than clustering apart from the aforementioned SEQ ID Nos.

According to the present invention, there is provided a method for enhancing yield-related traits in plants, comprising introducing and expressing in a plant a nucleic acid capable of hybridizing to any one of the nucleic acids given in the Table G of Example 11, or comprising introducing and expressing in a plant a nucleic acid capable of hybridising to a nucleic acid encoding an orthologue, paralogue or homologue of any of the nucleic acid sequences given in the Table G of Example 11.

Another nucleic acid variant useful in the methods of the invention is a splice variant encoding an Lsm protein as defined hereinabove.

According to the present invention, there is provided a method for enhancing yield-related traits in plants, comprising introducing and expressing in a plant a splice variant of any one of the nucleic acid sequences given in Table G of Example 11, or a splice variant of a nucleic acid encoding an orthologue, paralogue or homologue of any of the amino acid sequences given in Table G of Example 11.

Preferred splice variants are splice variants of a nucleic acid represented by SEQ ID NO: 40 or a splice variant of a nucleic acid encoding an orthologue or paralogue of SEQ ID NO: 41. Preferably, the amino acid sequence encoded by the splice variant comprises any one or more of the motifs or domains as defined herein. Preferably, the amino acid sequence encoded by the splice variant, when used in the construction of an Lsm phylogenetic tree, such as the one depicted in FIG. 10, tends to cluster within the clades corresponding to any one of the Class 1 to Class 8 clades or alternatively it tends to cluster with any of the representative Lsm proteins comprising the amino acid sequence represented by SEQ ID Nos 41, 43, 45, 47, 49, 51, 53, 55, 57, 59, and 61 rather than clustering apart from the aforementioned SEQ ID Nos.

Another nucleic acid variant useful in performing the methods of the invention is an allelic variant of a nucleic acid encoding an Lsm protein as defined hereinabove. Allelic variants exist in nature, and encompassed within the methods of the present invention is the use of these natural alleles. The allelic variants useful in the methods of the present invention have substantially the same biological activity as any of the Lsm proteins in Table G. As an example of an allelic variant of SEQ ID NO: 40 is provided in SEQ ID NO: 80.

According to the present invention, there is provided a method for enhancing yield-related traits in plants, comprising introducing and expressing in a plant an allelic variant of any one of the nucleic acids given in Table G of Example 11, or comprising introducing and expressing in a plant an allelic variant of a nucleic acid encoding an orthologue, paralogue or homologue of any of the amino acid sequences given in Table G of Example 11.

Preferably, the allelic variant is an allelic variant of SEQ ID NO: 40 or an allelic variant of a nucleic acid encoding an orthologue or paralogue of SEQ ID NO: 41. Preferably, the amino acid sequence encoded by the allelic variant comprises any one or more of the motifs or domains as defined herein. Preferably, the amino acid sequence encoded by the allelic variant, when used in the construction of an Lsm phylogenetic tree, such as the one depicted in FIG. 10, tends to cluster within the clades corresponding to any one of the Class 1 to Class 8 clades or alternatively it tends to cluster with any of the representative Lsm proteins comprising the amino acid sequence represented by SEQ ID Nos 41, 43, 45, 47, 49, 51, 53, 55, 57, 59, and 61 rather than clustering apart from the aforementioned SEQ ID Nos.

A further nucleic acid variant useful in the methods of the invention is a nucleic acid variant obtained by gene shuffling. Gene shuffling or directed evolution may also be used to generate variants of nucleic acids encoding Lsm proteins as defined above.

According to the present invention, there is provided a method for enhancing yield-related traits in plants, comprising introducing and expressing in a plant a variant of any one of the nucleic acid sequences given in Table G of Example 11, or comprising introducing and expressing in a plant a variant of a nucleic acid encoding an orthologue, paralogue or homologue of any of the amino acid sequences given in Table G of Example 11, which variant nucleic acid is obtained by gene shuffling.

Preferably, the variant nucleic acid obtained by gene shuffling encodes an amino acid sequence comprising any one or more of the motifs or domains as defined herein. Preferably, the amino acid encoded sequence by the variant nucleic acid obtained by gene shuffling, when used in the construction of an Lsm phylogenetic tree such as the one depicted in FIG. 10, tends to cluster within the clades corresponding to any one of the Class 1 to Class 8 clades or alternatively it tends to cluster with any of the representative Lsm proteins comprising the amino acid sequence represented by SEQ ID Nos 41, 43, 45, 47, 49, 51, 53, 55, 57, 59, and 61 rather than clustering apart from the aforementioned SEQ ID Nos.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding Lsm proteins may be derived from any natural or artificial source. The nucleic acid may be modified from its native form in composition and/or genomic environment through deliberate human manipulation. Preferably the Lsm-encoding nucleic acid is from a plant, further preferably from a dicotyledonous plant, more preferably from the Brassicae family, most preferably the nucleic acid is from *Arabidopsis thaliana*.

Any reference herein to an Lsm protein is therefore taken to mean an Lsm protein as defined above. Any nucleic acid encoding such an Lsm protein is suitable for use in performing the methods of the invention.

The present invention also encompasses plants or parts thereof (including seeds) obtainable by the methods according to the present invention. The plants or parts thereof comprise a nucleic acid transgene encoding an Lsm protein as defined above.

The invention also provides genetic constructs and vectors to facilitate introduction and/or expression of the nucleic acid sequences useful in the methods according to the invention, in a plant. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising
  (a) nucleic acid encoding an Lsm protein as defined above;
  (b) one or more control sequences capable of driving expression of the nucleic acid sequence of (a); and optionally
  (c) a transcription termination sequence.

The Lsm protein encoded by the nucleic acid of (a) above has an amino acid sequence in increasing order of preference, at least 50%, 60%, 70%, 75%, 80%, 85%, 90%, 95%, 96%, 97%, 98%, 99% or 100% sequence identity to a sequence selected from a group of SEQ ID Nos 120, 121, 122, 123, 124, 125, 126, 127, 128, 129 and 130.

Preferably the nucleic acid of (a) above is:
  (i) Any of SEQ ID No.: 82, 84, 86, 88, 90, 92, 94, 96, 98, 100, 102, 104, 106, 108, 110, 112, 114 and 116 or
  (ii) a nucleic acid capable of hybridizing under stringent conditions to any one of the nucleic acids given in (i) or to a nucleic acid having a complementary sequence to any of the nucleic acids given in (i).

Plants are transformed with a vector comprising the sequence of interest (i.e., a nucleic acid encoding an Lsm polypeptide as defined herein. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence.

The promoter may be a constitutive promoter or an organ-specific or tissue-specific promoter or a cell-specific promoter.

Preferably, the Lsm nucleic acid or variant thereof is operably linked to a seed-specific promoter. Preferably, the seed-specific promoter is a WSI18 promoter or a functionally equivalent promoter. More preferably, the promoter sequence is as represented by SEQ ID NO: 161 or SEQ ID NO: 164. It should be clear that the applicability of the present invention is not restricted to the Lsm nucleic acid represented by SEQ ID NO: 40, nor is the applicability of the invention restricted to expression of an Lsm nucleic acid when driven by a seed-specific promoter. Examples of other seed-specific promoters which may also be used to drive expression of an Lsm nucleic acid are shown in the definitions section.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid encoding an Lsm protein as defined hereinabove.

More specifically, the present invention provides a method for the production of transgenic plants having enhance yield-related traits, which method comprises:
  (i) introducing and expressing in a plant or plant cell an Lsm nucleic acid or variant thereof; and
  (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an Lsm protein as defined hereinabove. Preferred host cells according to the invention are plant cells.

Host plants for the nucleic acids or the vector used in the method according to the invention, the expression cassette or construct or vector are, in principle, advantageously all plants, which are capable of synthesizing the polypeptides used in the inventive method.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression.

As mentioned above, a preferred method for modulating (preferably, increasing) expression of a nucleic acid encoding an Lsm protein is by introducing and expressing in a plant a nucleic acid encoding an Lsm protein; however the effects of performing the method, i.e. enhancing yield-related traits may also be achieved using other well known techniques and examples are provided in the definitions section.

As mentioned above, a preferred method for modulating expression of a nucleic acid encoding a Lsm polypeptide is by introducing and expressing in a plant a nucleic acid encoding a Lsm polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

Performance of the methods of the invention gives plants having enhanced yield-related traits. Reference herein to enhanced yield-related traits is taken to mean an increase in biomass (weight) of one or more parts of a plant, which may include aboveground (harvestable) parts and/or (harvestable) parts below ground.

In particular, such harvestable parts are seeds, and performance of the methods of the invention results in plants having increased seed yield relative to the seed yield of suitable control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

Since the transgenic plants according to the present invention have increased yield, it is likely that these plants exhibit an increased growth rate (during at least part of their life cycle), relative to the growth rate of control plants at a corresponding stage in their life cycle. The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soy bean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding an Lsm protein as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, nematodes, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding an Lsm polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a Lsm polypeptide. Nutrient deficiency may result from a lack of nutrients such as nitrogen, phosphates and other phosphorous-containing compounds, potassium, calcium, cadmium, magnesium, manganese, iron and boron, amongst others.

In a preferred embodiment of the invention, the increase in yield and/or growth rate occurs under non-stress conditions.

In a another preferred embodiment of the invention, the enhanced yield-related traits were observed under mild drought conditions, most preferably the drought condition is according to watering Regime 2 as described in Example 18.

The methods of the invention are advantageously applicable to any plant.

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum, emmer, spelt, ecale, einkorn, teff, milo and oats.

The invention also extends to harvestable parts of a plant such as, but not limited to seeds, leaves, fruits, flowers, stems, roots, rhizomes, tubers and bulbs. The invention furthermore relates to products derived, preferably directly derived, from a harvestable part of such a plant, such as dry pellets or powders, oil, fat and fatty acids, starch or proteins.

The present invention also provides hitherto unknown Lsm nucleic acids and Lsm proteins, these sequences also being useful in performing the methods of the invention.

According to a further embodiment of the present invention, there is therefore provided an isolated nucleic acid molecule comprising:
(i) a nucleic acid represented by SEQ ID NO: 82, SEQ ID NO: 84, SEQ ID NO: 86 SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114 or SEQ ID NO: 116;
(ii) the complement of any one of the SEQ ID NOs given in (i);
(iii) a nucleic acid encoding an Lsm protein having, in increasing order of preference, at least 80%, 85%, 90%, 95%, 96%, 97%, 98%, 99% or 100% sequence identity to any one of the amino acid sequences given in SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117;
(iv) a nucleic acid capable of hybridizing under stringent conditions to any one of the nucleic acids given in (i), (ii) or (iii) above.

According to a further embodiment of the present invention, there is provided an isolated polypeptide comprising:
(i) an amino acid sequence represented by any one of SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117;
(ii) an amino acid sequence having, in increasing order of preference, at least 80%, 85%, 90%, 95%, 96%, 97%, 98%, 99% or 100% sequence identity to any one of the amino acid sequences given in SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117;
(iii) derivatives of any of the amino acid sequences given in (i) or (ii) above.

The present invention also encompasses use of nucleic acids encoding the Lsm protein described herein and use of these Lsm proteins in enhancing yield-related traits in plants.

Nucleic acids encoding the Lsm protein described herein, or the Lsm proteins themselves, may find use in breeding programmes in which a DNA marker is identified which may be genetically linked to an Lsm-encoding gene. The nucleic acids/genes, or the Lsm proteins themselves may be used to define a molecular marker. This DNA or protein marker may then be used in breeding programmes to select plants having enhanced yield-related traits as defined hereinabove in the methods of the invention.

Allelic variants of an Lsm protein-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding Lsm proteins may also be used as probes for genetically and physically mapping the genes that they are a part of, and as markers for traits linked to those genes. Such information may be useful in plant breeding in order to develop lines with desired phenotypes. Such use of Lsm protein-encoding nucleic acids requires only a nucleic acid sequence of at least 15 nucleotides in length. The Lsm protein-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the Lsm protein-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the Lsm protein-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res.

18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

III. Truncated Cyclin H

According to a first embodiment, the present invention provides a method for enhancing yield-related traits in plants relative to control plants, comprising modulating expression in a plant of a nucleic acid encoding a truncated Cyclin H polypeptide, hereafter also named $CycH_{Tr}$.

A preferred method for modulating (preferably, increasing) expression of a nucleic acid encoding a $CycH_{Tr}$ polypeptide is by introducing and expressing in a plant a nucleic acid encoding a $CycH_{Tr}$ polypeptide.

Any reference hereinafter to a "protein useful in the methods of the invention" is taken to mean a $CycH_{Tr}$ polypeptide as defined herein. The term also encompasses cyclin H polypeptides that are used for generating a truncated form as defined below. Any reference hereinafter to a "nucleic acid useful in the methods of the invention" is taken to mean a nucleic acid capable of encoding such a $CycH_{Tr}$ polypeptide or encoding a cyclin H polypeptide used for generating a truncated form as defined below. The nucleic acid to be introduced into a plant (and therefore useful in performing the methods of the invention) is any nucleic acid encoding the type of protein which will now be described, hereafter also named "$CycH_{Tr}$ nucleic acid" or "$CycH_{Tr}$ gene".

Cyclin H polypeptides are proteins that typically bind and activate CDK-activating kinases (CAK). Cyclin H is reported to comprise 2 characteristic alpha-helix domains, each of them containing 5 helices (referred to as H1 to H5 and H1' to H5'), and an N-terminal and a C-terminal helix (Hn and Hc, see FIG. 13) (Andersen et al, EMBO Journal 16, 958-967, 1997). Cyclin H comprises the characteristic cyclin box (FIG. 13), a domain present in all cyclins; furthermore, CycH preferably also comprises the conserved motif 1 (L/v/I) (Q/R) (E/D) VCXAF (SEQ ID NO: 169).

A "CycH polypeptide" may also be defined as a cyclin having, in increasing order of preference, at least 20%, 25%, 30%, 35%, 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 8% 7, 89%, 90%, 91%, 92%, 93%, 94%, 95% 96%, 97%, 98%, 99% or more sequence identity to SEQ ID NO: 173.

Furthermore, cyclins (at least in their native form) may have CDK-binding activity. CycH in particular is reported to bind and activate CAK proteins. Tools and techniques for measuring protein-protein interactions (including two-hybrid assays) and for measuring kinase activity (in particular CAK activity) are well known in the art, for further details see example 25.

The methods of the present invention make use of a truncated cyclin H. Useful truncated forms of cycH are those that are still capable of binding to CAK, but that are not capable of activating CAK. Guidance for measuring cycH binding and CAK activation may be found in Andersen et al. (1997). Preferably, the truncated cyclin H lacks at least the Hc helix domain, further preferably the truncated cyclin H lacks also the H5' helix domain, more preferably the truncated cyclin H lacks the Hc, the H5' and H4' helices. In a particular embodiment the truncated cyclin H is, compared to the full length cyclin H protein sequence, characterised by the absence of the helices H3', H4', H5' and Hc. Preferably, the truncated cycH is as represented by SEQ ID NO: 166. However, as outlined in Andersen et al. (1997), deletion of other helix domains also result in loss of the CAK activating activity. These deletion variants are also encompassed by the term "truncated cyclin H" or "$CycH_{Tr}$," and are equally useful in the methods of the present invention.

Preferably, the polypeptide sequence which when used in the construction of a phylogenetic tree, such as the one depicted in FIG. 15, clusters with the group of CycH polypeptides comprising the amino acid sequence represented by SEQ ID NO: 166 or SEQ ID NO: 173 rather than with any other group.

The terms "domain" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). Domains may also be identified using routine techniques, such as by sequence alignment.

Analysis of the polypeptide sequence of SEQ ID NO: 166 in the SMART database, revealed there to be cyclin box, SMART entry SM00385 (See FIG. 13).

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. For local alignments, the Smith-Waterman algorithm is particularly useful (Smith T F, Waterman M S (1981) J. Mol. Biol. 147(1); 195-7). The sequence identity values, which are indicated below in Example 3 as a percentage were determined over the entire nucleic acid or amino acid sequence, and/or over selected domains or conserved motif(s), using the programs mentioned above using the default parameters.

The present invention is illustrated by transforming plants with the nucleic acid sequence represented by SEQ ID NO: 165, encoding the polypeptide sequence of SEQ ID NO: 166. However, performance of the invention is not restricted to these sequences; the methods of the invention may advantageously be performed using truncated forms of any CycH-encoding nucleic acid or CycH polypeptides as defined herein, the truncated form being as described above.

Examples of nucleic acids encoding CycH polypeptides are given in Table K of Example 20 herein. Such nucleic acids are useful for generating truncated forms of cyclin H in performing the methods of the invention. The amino acid sequences given in Table K of Example 1 are example sequences of orthologues and paralogues of the CycH polypeptides represented by SEQ ID NO: 173, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table K of Example 20) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 172 or SEQ ID NO: 173, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table K of Example 20, the terms "homologue" and "derivative" being as defined herein. Also useful in the methods of the invention are nucleic acids encoding homologues and derivatives of orthologues or paralogues of any one of the amino acid sequences given in Table K of Example 20. Homologues and derivatives useful in the methods of the present invention have substantially the same biological and functional activity as the unmodified protein from which they are derived.

Further nucleic acid variants useful in practising the methods of the invention include portions of nucleic acids encoding CycH polypeptides, nucleic acids hybridising to nucleic acids encoding CycH polypeptides, splice variants of nucleic acids encoding CycH polypeptides, allelic variants of nucleic acids encoding CycH polypeptides and variants of nucleic acids encoding CycH polypeptides obtained by gene shuffling. All these nucleic acids and variants thereof may be used to generate nucleic acids encoding a cyCH$_{Tr}$ polypeptide as described above. The terms hybridising sequence, splice variant, allelic variant and gene shuffling are as described herein.

Nucleic acids encoding CycH polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table K of Example 20, or a portion of a nucleic acid encoding an orthologue, paralogue or homologue of any of the amino acid sequences given in Table K of Example 20. Preferably, the portion encodes a truncated cyclin H polypeptide as described above.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a CycH$_{Tr}$ polypeptide as defined herein, and have substantially the same biological activity as the amino acid sequence of SEQ ID NO: 166. Preferably, the portion is a portion of any one of the nucleic acids given in Table K of Example 20, or is a portion of a nucleic acid encoding an orthologue or paralogue of any one of the amino acid sequences given in Table K of Example 20. Preferably the portion is at least 100, 150, 200, 250, or 300 consecutive nucleotides in length, the consecutive nucleotides being of any one of the nucleic acid sequences given in Table K of Example 20, or of a nucleic acid encoding an orthologue or paralogue of any one of the amino acid sequences given in Table K of Example 20. More preferably the portion is a portion of the nucleic acid of SEQ ID NO: 172, most preferably, the portion is the nucleic acid represented by SEQ ID NO: 165. Preferably, the portion encodes an amino acid sequence comprising (any one or more of the domains or motifs defined herein). Preferably, the portion encodes an amino acid sequence which when used in the construction of a phylogenetic tree, such as the one depicted in FIG. 15, tends to cluster with the group of CycH$_{Tr}$ polypeptides comprising the amino acid sequence represented by SEQ ID NO: 166 or SEQ ID NO: 173 rather than with any other group.

Another nucleic acid variant useful in the methods of the invention is a nucleic acid capable of hybridising, under reduced stringency conditions, preferably under stringent conditions, with a nucleic acid encoding a CycH polypeptide as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table K of Example 20, or comprising introducing and expressing in a plant a nucleic acid capable of hybridising to a nucleic acid encoding an orthologue, paralogue or homologue of any of the nucleic acid sequences given in Table K of Example 20. Preferably, the hybridising nucleic acid encodes a truncated cyclin H as described above.

Hybridising sequences useful in the methods of the invention encode a $CycH_{Tr}$ polypeptide as defined herein, and encode a polypeptide having substantially the same biological activity as the amino acid sequence of SEQ ID NO: 166. Preferably, the hybridising sequence is capable of hybridising to any one of the nucleic acids given in Table K of Example 20, or to a portion of any of these sequences, a portion being as defined above, or the hybridising sequence is capable of hybridising to a nucleic acid encoding an orthologue or paralogue of any one of the amino acid sequences given in Table K of Example 20. Most preferably, the hybridising sequence is capable of hybridising to a nucleic acid as represented by SEQ ID NO: 165 or to a portion thereof. Preferably, the hybridising sequence encodes an amino acid sequence comprising any one or more of the motifs or domains as defined herein. Preferably, the hybridising sequence encodes an amino acid sequence which when used in the construction of a phylogenetic tree, such as the one depicted in FIG. 15, tends to cluster with the group of CycH polypeptides comprising the amino acid sequence represented by SEQ ID NO: 166 or SEQ ID NO: 173 rather than with any other group.

Another nucleic acid variant useful in the methods of the invention is a splice variant of a nucleic acid encoding a CycH polypeptide as defined hereinabove, a splice variant being as defined herein. Preferably, the splice variant, or a portion thereof, encodes a $CycH_{Tr}$ polypeptide as described above.

According to the present invention, there is provided a method for enhancing yield-related traits in plants, comprising introducing and expressing in a plant a splice variant of any one of the nucleic acid sequences given in Table K of Example 20, or a splice variant of a nucleic acid encoding an orthologue, paralogue or homologue of any of the amino acid sequences given in Table K of Example 20. Preferably, the splice variant encodes a truncated cyclin H as described above.

Preferred splice variants are splice variants of any one of the nucleic acids encoding a truncated form of a CycH polypeptide given in Table K of Example 20, or a splice variant of a nucleic acid encoding a truncated orthologues, paralogue or homologue of any of the amino acid sequences given in Table K of Example 20. Preferably, the amino acid sequence encoded by the splice variant comprises any one or more of the motifs or domains of the $CycH_{Tr}$ as defined herein. Preferably, the amino acid sequence encoded by the splice variant, when used in the construction of a phylogenetic tree, such as the one depicted in FIG. 15, tends to cluster with the group of CycH polypeptides comprising the amino acid sequence represented by SEQ ID NO: 166 or SEQ ID NO: 173 rather than with any other group.

Another nucleic acid variant useful in performing the methods of the invention is an allelic variant of a nucleic acid encoding a CycH polypeptide as defined hereinabove, an allelic variant being as defined herein. Preferably, the allelic variant encodes a truncated form of cyclin H as described above.

According to the present invention, there is provided a method for enhancing yield-related traits in plants, comprising introducing and expressing in a plant an allelic variant of any one of the nucleic acids encoding a truncated form of a CycH polypeptide given in Table K of Example 20, or comprising introducing and expressing in a plant an allelic variant of a nucleic acid encoding a truncated orthologue, paralogue or homologue of any of the amino acid sequences given in Table K of Example 20. Preferably, the allelic variant encodes a truncated cyclin H as described above.

The polypeptides encoded by the allelic variants useful in the methods of the present invention have substantially the same biological activity as the $CycH_{Tr}$ polypeptide of SEQ ID NO: 166 and a truncated form as described above of any of the amino acid sequences depicted in Table K of Example 20. Allelic variants exist in nature, and encompassed within the methods of the present invention is the use of these natural alleles. Preferably, the allelic variant is an allelic variant of SEQ ID NO: 165 or SEQ ID NO: 172, or an allelic variant of a nucleic acid encoding an orthologue or paralogue of SEQ ID NO: 166 or SEQ ID NO: 173. Preferably, the amino acid encoded by the allelic variant comprises any one or more of the motifs or domains of $CycH_{Tr}$ as defined herein. Preferably, the amino acid sequence encoded by the allelic variant, when used in the construction of a phylogenetic tree, such as the one depicted in FIG. 15, tends to cluster with the group of CycH polypeptides comprising the amino acid sequence represented by SEQ ID NO: 166 or SEQ ID NO: 173, rather than with any other group.

Gene shuffling or directed evolution may also be used to generate variants of nucleic acids encoding $CycH_{Tr}$ polypeptides as defined above; the term "gene shuffling" being as defined herein.

According to the present invention, there is provided a method for enhancing yield-related traits in plants, comprising introducing and expressing in a plant a portion of any one of the nucleic acid sequences given in Table K of Example 20 or a variant thereof, or comprising introducing and expressing in a plant a portion of a nucleic acid encoding an orthologue, paralogue or homologue of any of the amino acid sequences given in Table K of Example 20, which nucleic acid is obtained by gene shuffling. Preferably, the portion encodes a truncated cyclin H as defined above.

Preferably, the variant nucleic acid obtained by gene shuffling encodes an amino acid sequence comprising any one or more of the motifs or domains as defined herein. Preferably, the amino acid sequence encoded by the variant nucleic acid obtained by gene shuffling, when used in the construction of a phylogenetic tree such as the one depicted in FIG. 15, tends to cluster with the group of CycH polypeptides comprising the amino acid sequence represented by SEQ ID NO: 166 or SEQ ID NO: 173, rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding $CycH_{Tr}$ polypeptides may be derived from any natural or artificial source. The nucleic acid may be modified from its native form in composition and/or genomic environment through deliberate human manipulation. Preferably the $CycH_{Tr}$ polypeptide-encoding nucleic acid is derived from a plant, further preferably from a dicotyledonous plant, more preferably from the family Brassicaceae, more preferably from the genus *Arabidopsis*, most preferably from *Arabidopsis thaliana*.

Performance of the methods of the invention gives plants having enhanced yield-related traits. In particular, performance of the methods of the invention gives plants having increased yield, especially increased biomass and/or increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds and/or (vegetative) biomass, and performance of the methods of the invention results in plants having increased biomass and/or increased seed yield relative to the biomass and seed yield of control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression, preferably increasing expression, in a plant of a nucleic acid encoding a $CycH_{Tr}$ polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle. Besides the increased yield capacity, an increased efficiency of nutrient uptake may also contribute to the increase in yield. It is observed that the plants according to the present invention show a higher efficiency in nutrient uptake. Increased efficiency of nutrient uptake allows better growth of the plant, when the plant is under stress.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding a $CycH_{Tr}$ polypeptide as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with an increased yield when grown under nitrogen-limiting conditions.

Biotic stresses are typically those stresses caused by pathogens, such as bacteria, viruses, nematodes, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding a $CycH_{Tr}$ polypeptide.

The present invention encompasses plants or parts thereof (including seeds) obtainable by the methods according to the present invention. The plants or parts thereof comprise a nucleic acid transgene encoding a $CycH_{Tr}$ polypeptide as defined above.

The invention also provides genetic constructs and vectors to facilitate introduction and/or expression in plants of nucleic acids encoding $CycH_{Tr}$ polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a $CycH_{Tr}$ polypeptide as defined above;
(b) one or more control sequences capable of driving expression of the nucleic acid sequence of (a); and optionally
(c) a transcription termination sequence.

Preferably, the nucleic acid encoding a $CycH_{Tr}$ polypeptide is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. Preferably, the $CycH_{Tr}$ nucleic acid or variant thereof is operably linked to a seed-specific promoter. A seed-specific promoter is transcriptionally active predominantly in seed tissue, but not necessarily exclusively in seed tissue (in cases of leaky expression). The seed-specific promoter may be active during seed development and/or during germination. Seed-specific promoters are well known in the art. Preferably, the seed-specific promoter is an oleosin promoter, or a WSI18 promoter, or a functionally equivalent promoter. More preferably, the promoter sequence is as represented by one of SEQ ID NO: 170, SEQ ID NO: 171 and SEQ ID NO: 164. It should be clear that the applicability of the present invention is not restricted to the $CycH_{Tr}$ nucleic acid represented by SEQ ID NO: 165, nor is the applicability of the invention restricted to expression of a $CycH_{Tr}$ nucleic acid when driven by a seed-specific promoter. Examples of other seed-specific promoters which may also be used to drive expression of a $CycH_{Tr}$ nucleic acid are shown in the definitions section.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid encoding a $CycH_{Tr}$ polypeptide as defined hereinabove.

More specifically, the present invention provides a method for the production of transgenic plants having increased yield, which method comprises:
(i) introducing and expressing in a plant or plant cell a $CycH_{Tr}$ polypeptide-encoding nucleic acid; and
(ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S.D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a $CycH_{Tr}$ polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum, emmer, spelt, secale, einkorn, teff, milo and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating (preferably, increasing) expression of a nucleic acid encoding a $CycH_{Tr}$ polypeptide is by introducing and expressing in a plant a nucleic acid encoding a $CycH_{Tr}$ polypeptide; however the effects of performing the method, i.e. enhancing yield-related traits may also be achieved using other well known techniques, including but not limited to T-DNA activation tagging, TILLING, homologous recombination. A description of some of these techniques is provided in the definitions section.

Furthermore, EMS mutagenesis, or insertion mutagenesis using T-DNA or transposons may be used for generating mutations in endogenous CycH genes, resulting in the formation of a $CycH_{TR}$ encoding sequence. These techniques are well known in the art.

The present invention also encompasses use of nucleic acids encoding $CycH_{Tr}$ polypeptides as described herein and use of these $CycH_{Tr}$ polypeptide in enhancing any of the aforementioned yield-related traits in plants.

Nucleic acids encoding $CycH_{Tr}$ polypeptide described herein, or the $CycH_{Tr}$ polypeptides themselves, may find use in breeding programmes in which a DNA marker is identified which may be genetically linked to a $CycH_{Tr}$ polypeptide-encoding gene. The nucleic acids/genes, or the $CycH_{Tr}$ polypeptides themselves may be used to define a molecular marker. This DNA or protein marker may then be used in breeding programmes to select plants having enhanced yield-related traits as defined hereinabove in the methods of the invention.

Allelic variants of a CycH$_{Tr}$ polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding CycH$_{Tr}$ polypeptides may also be used as probes for genetically and physically mapping the genes that they are a part of, and as markers for traits linked to those genes. Such information may be useful in plant breeding in order to develop lines with desired phenotypes. Such use of CycH$_{Tr}$ polypeptide-encoding nucleic acids requires only a nucleic acid sequence of at least 15 nucleotides in length. The CycH$_{Tr}$ polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the CycH$_{rr}$-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the CycH$_{Tr}$ polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

IV. Remorin

According to a first embodiment, the present invention provides a method for enhancing yield-related traits in plants relative to control plants, comprising increasing expression in a plant of a nucleic acid sequence encoding a Remorin polypeptide.

A preferred method for increasing expression of a nucleic acid sequence encoding a Remorin polypeptide is by introducing and expressing in a plant a nucleic acid sequence encoding a Remorin polypeptide.

Any reference hereinafter to a "protein useful in the methods of the invention" is taken to mean a Remorin polypeptide as defined herein. Any reference hereinafter to a "nucleic acid sequence useful in the methods of the invention" is taken to mean a nucleic acid sequence capable of encoding such a Remorin polypeptide. The nucleic acid sequence to be introduced into a plant (and therefore useful in performing the methods of the invention) is any nucleic acid sequence encoding the type of protein, which will now be described, hereafter also named "Remorin nucleic acid sequence" or "Remorin gene".

A "Remorin polypeptide" as defined herein refers to any polypeptide comprising (i) a C-terminal Remorin domain (corresponding to Pfam family accession number PF03763); and (ii) a C-terminal predicted coiled coil domain.

Additionally, a "Remorin polypeptide" as defined herein additionally comprises one or both of: (i) a C-terminal Remorin domain enriched in charged amino acids; (ii) at least one Cys and/or one Phe comprised in the last ten amino acid residues at the C-terminus of the polypeptide.

Alternatively or additionally, a "Remorin polypeptide" as defined herein refers to any polypeptide comprising a C-terminal Remorin domain having in increasing order of preference at least 15%, 20%, 25%, 30%, 35%, 40%, 45%, 50%, 55%, 60%, 65%, 70%, 75%, 80%, 85%, 90%, 95%, 98%, 99% or more sequence identity to the C-terminal Remorin domain as represented by SEQ ID NO: 326.

Alternatively or additionally, a "Remorin polypeptide" as defined herein refers to any polypeptide having in increasing order of preference at least 10%, 15%, 20%, 25%, 30%, 35%, 40%, 45%, 50%, 55%, 60%, 65%, 70%, 75%, 80%, 85%, 90%, 95%, 98%, 99% or more sequence identity to a Remorin polypeptide as represented by SEQ ID NO: 199.

The terms "domain" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., (2004) Nucl. Acids. Res. 32: D134-D137), or Pfam (Bateman et al., (2002) Nucleic Acids Research 30(1): 276-280). A set of tools for in silico analysis of protein sequences is available on the ExPASY proteomics server (hosted by the Swiss Institute of Bioinformatics (Gasteiger et al., (2003) ExPASy: the proteomics server for in-depth protein knowledge and analysis, Nucleic Acids Res 31: 3784-3788). Domains may also be identified using routine techniques, such as by sequence alignment. Analysis of the polypeptide sequence of SEQ ID NO: 199 is presented below in Examples 32 and 34. The C-terminal Remorin domain is identified in the Pfam database as the Pfam family accession number PF03763, in the Prodom database as the accession number PD350442. The C-terminal Remorin domain of SEQ ID NO: 199, as identified in the Pfam database, is as represented by SEQ ID NO: 326. Because the percentage identity between the C-terminal Remorin domain of Remorin polypeptides is reputedly, the identification of such domains using the algorithms of specialized databases such as Pfam, is particularly useful.

The "N-terminus" (also known as the "N-terminal end" or the "amine-terminus") is herein taken to mean the extremity of a protein or polypeptide or peptide terminated by an amino acid with a free amine group (—NH2). The "C-terminus" (also known as "C-terminal end" or the "carboxyl-terminus") of a protein or polypeptide or peptide is the extremity of the amino acid chain terminated by a free carboxyl group (—COOH). By "C-terminal half" is herein taken to mean the half of the polypeptide comprising the C-terminus. By "C-terminal domain" is herein taken to mean a domain comprised in the half of the polypeptide comprising the C-terminus. The presence of at least one Cys and/or one Phe in the last ten amino acid residues at the C-terminus of the Remorin polypeptide can be done simply by eye inspection. Once the C-terminus of the Remorin polypeptide is identified, the ten amino acid residues upstream of it (in the direction of the N-terminus) are examined for the presence of at least one Cys and/or one Phe.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. For local alignments, the Smith-Waterman algorithm is particularly useful (Smith T F, Waterman M S (1981) J. Mol. Biol. 147(1); 195-7). The sequence identity values, which are indicated below in Example 33 as a percentage were determined over the entire nucleic acid or polypeptide sequence (Table Q herein), and/or over selected domains (such as the C-terminal Remorin domain as represented by SEQ ID NO: 326; Table Q1 herein) or conserved motif(s), using the programs mentioned above using the default parameters. Percentage identity between Remorin polypeptides is reputedly low (as low as 10%), between the C-terminal Remorin domain of Remorin polypeptides slightly higher (15% or more).

Furthermore, the presence of regions rich in specific amino acids (such as a domain rich in charged amino acids) may identified using computer algorithms or simply by eye inspection. For the former, primary amino acid composition (in %) to determine if a polypeptide region is rich in specific amino acids may be calculated using software programs from the ExPASy server, in particular the ProtParam tool (Gasteiger E et al. (2003) ExPASy: the proteomics server for in-depth protein knowledge and analysis. Nucleic Acids Res 31:3784-3788). The composition of the polypeptide of interest may then be compared to the average amino acid composition (in %) in the Swiss-Prot Protein Sequence data bank. Within this databank, the average % of charged amino acids (Asp, Glu Lys and Arg) is of 23% (Table F herein). As defined herein, a C-terminal Remorin domain of a Remorin polypeptide is enriched in charged amino acids if the percentage of charged amino acids residues of this Remorin domain is above the percentage of charged amino acids in the Swiss-Prot Protein Sequence data bank. Preferably, the percentage of charged amino acids in a C-terminal Remorin domain of a Remorin polypeptide is 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30% or more, than the percentage of charged amino acids in the Swiss-Prot Protein Sequence data bank. For example, the C-terminal Remorin domain as represented by SEQ ID NO: 326 comprises 40% of charged amino acids, particularly of Lys, Arg, and Glu, as shown in Example 36.

Coiled coils are important to identify for protein-protein interactions, such as oligomerization, either of identical proteins, of proteins of the same family, or of unrelated proteins. A Remorin polypeptide can interact with itself, or with a Remorin orthologue or a paralogue. Recently much progress has been made in computational prediction of coiled coils from sequence data. Among algorithms well known to a person skilled in the art are available at the ExPASy Proteomics tools COILS, PAIRCOIL, PAIRCOIL2, MULTICOIL, or MARCOIL, hosted by the Swiss Institute for Bioinformatics. In Example 36 and FIG. 19, are shown respectively the numerical and graphical results of SEQ ID NO: 199 as produced by the COILS algorithm analysis. A C-terminal predicted coiled coil domain is identified in the Remorin polypeptide sequence as represented by SEQ ID NO: 199.

The present invention is illustrated by transforming plants with the nucleic acid sequence represented by SEQ ID NO: 198, encoding the polypeptide sequence of SEQ ID NO: 199. However, performance of the invention is not restricted to these sequences; the methods of the invention may advantageously be performed using any Remorin-encoding nucleic acid sequence or Remorin polypeptide as defined herein.

Examples of nucleic acid sequences encoding plant Remorin polypeptides are listed in Table P of Example 31 herein. Such nucleic acid sequences are useful in performing the methods of the invention. The polypeptide sequences listed in Table P of Example 31 are example sequences of orthologues and paralogues of the Remorin polypeptides represented by SEQ ID NO: 199, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table P of Example 31) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 198 or SEQ ID NO: 199, the second BLAST would therefore be against Arabidopsis sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acid sequences encoding homologues and derivatives of any one of the polypeptide sequences listed in Table P of Example 31, the terms "homologue" and "derivative" being as defined herein. Also useful in the methods of the invention are nucleic acid sequences encoding homologues and derivatives of orthologues or paralogues of any one of the polypeptide sequences listed in Table P of Example 31. Homologues and derivatives useful in the methods of the present invention have substantially the same biological and functional activity as the unmodified protein from which they are derived.

Further nucleic acid variants useful in practising the methods of the invention include portions of nucleic acid sequences encoding Remorin polypeptides, nucleic acid sequences hybridising to nucleic acid sequences encoding Remorin polypeptides, splice variants of nucleic acid sequences encoding Remorin polypeptides, allelic variants of nucleic acid sequences encoding Remorin polypeptides, and variants of nucleic acid sequences encoding Remorin polypeptides obtained by gene shuffling. The terms portion, hybridising sequence, splice variant, allelic variant and gene shuffling are as described herein.

Nucleic acid sequences encoding Remorin polypeptides need not be full-length nucleic acid sequences, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences listed in Table P of Example 31, or a portion of a nucleic acid sequence encoding an orthologue, paralogue or homologue of any of the polypeptide sequences listed in Table P of Example 31.

A portion of a nucleic acid sequence may be prepared, for example, by making one or more deletions to the nucleic acid sequence. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode Remorin polypeptides as defined herein, and have substantially the same biological activity as the polypeptide sequences listed in Table P of Example 31. Preferably, the portion is a portion of any one of the nucleic acid sequences listed in Table P of Example 31, or is a portion of a nucleic acid sequence encoding an orthologue or paralogue of any one of the polypeptide sequences listed in Table P of Example 31. Preferably the portion is, in increasing order of preference at least 200, 300, 400, 500 or 600 consecutive nucleotides in length, the consecutive nucleotides being of any one of the nucleic acid sequences listed in Table P of Example 31, or of a nucleic acid sequence encoding an orthologue or paralogue of any one of the polypeptide sequences listed in Table P of Example 31. Preferably, the portion encodes a polypeptide sequence comprising any one or more of the domains or motifs defined herein. Most preferably the portion is a portion of the nucleic acid sequence of SEQ ID NO: 198.

Another nucleic acid variant useful in the methods of the invention is a nucleic acid sequence capable of hybridising, under reduced stringency conditions, preferably under stringent conditions, with a nucleic acid sequence encoding a Remorin polypeptide as defined herein, or with a portion as defined herein.

According to the present invention, there is provided a method for enhancing yield-related traits in plants, comprising introducing and expressing in a plant a nucleic acid sequence capable of hybridizing to any one of the nucleic acid sequences listed in Table P of Example 31, or comprising introducing and expressing in a plant a nucleic acid sequence capable of hybridising to a nucleic acid sequence encoding an orthologue, paralogue or homologue of any of the nucleic acid sequences listed in Table P of Example 31.

Hybridising sequences useful in the methods of the invention encode a Remorin polypeptide as defined herein, and have substantially the same biological activity as the polypeptide sequences listed in Table P of Example 31. Preferably, the hybridising sequence is capable of hybridising to any one of the nucleic acid sequences listed in Table P of Example 31, or to a portion of any of these sequences, a portion being as defined above, or wherein the hybridising sequence is capable of hybridising to a nucleic acid sequence encoding an orthologue or paralogue of any one of the polypeptide sequences listed in Table P of Example 31. Preferably, the hybridising sequence encodes a polypeptide sequence comprising any one or more of the motifs or domains as defined herein. Most preferably, the hybridising sequence is capable of hybridising to a nucleic acid sequence as represented by SEQ ID NO: 198 or to a portion thereof.

Another nucleic acid variant useful in the methods of the invention is a splice variant encoding a Remorin polypeptide as defined hereinabove, a splice variant being as defined herein.

According to the present invention, there is provided a method for enhancing yield-related traits in plants, comprising introducing and expressing in a plant a splice variant of any one of the nucleic acid sequences listed in Table P of Example 31, or a splice variant of a nucleic acid sequence encoding an orthologue, paralogue or homologue of any of the polypeptide sequences listed in Table P of Example 31.

The splice variants useful in the methods of the present invention have substantially the same biological activity as the Remorin polypeptide of SEQ ID NO: 199 and any of the polypeptide sequences depicted in Table P of Example 31. Preferably, the polypeptide sequence encoded by the splice variant comprises any one or more of the motifs or domains as defined herein.

Most preferably the splice variant is a splice variant of the nucleic acid sequence of SEQ ID NO: 198 or a splice variant of a nucleic acid sequence encoding an orthologue or paralogue of SEQ ID NO: 199.

Another nucleic acid variant useful in performing the methods of the invention is an allelic variant of a nucleic acid sequence encoding a Remorin polypeptide as defined hereinabove, an allelic variant being as defined herein.

According to the present invention, there is provided a method for enhancing yield-related traits in plants, comprising introducing and expressing in a plant an allelic variant of any one of the nucleic acid sequences listed in Table P of Example 31, or comprising introducing and expressing in a plant an allelic variant of a nucleic acid sequence encoding an orthologue, paralogue or homologue of any of the polypeptide sequences listed in Table P of Example 31.

The allelic variants useful in the methods of the present invention have substantially the same biological activity as the Remorin polypeptide of SEQ ID NO: 199 and any of the polypeptide sequences depicted in Table P of Example 1. Allelic variants exist in nature, and encompassed within the methods of the present invention is the use of these natural alleles. Preferably, the polypeptide sequence encoded by the allelic variant comprises any one or more of the motifs or domains as defined herein. Most preferably, the allelic variant is an allelic variant of SEQ ID NO: 198 or an allelic variant of a nucleic acid sequence encoding an orthologue or paralogue of SEQ ID NO: 199.

Gene shuffling or directed evolution may also be used to generate variants of nucleic acid sequences encoding Remorin polypeptides as defined hereinabove, the term "gene shuffling" being as defined herein.

According to the present invention, there is provided a method for enhancing yield-related traits in plants, comprising introducing and expressing in a plant a variant of any one of the nucleic acid sequences listed in Table P of Example 31, or comprising introducing and expressing in a plant a variant of a nucleic acid sequence encoding an orthologue, paralogue or homologue of any of the polypeptide sequences listed in Table P of Example 31, which variant nucleic acid sequence is obtained by gene shuffling.

The variant nucleic acid sequences obtained by gene shuffling useful in the methods of the present invention have substantially the same biological activity as the Remorin polypeptide of SEQ ID NO: 199 and any of the polypeptide sequences depicted in Table P of Example 31. Preferably, the variant nucleic acid sequence obtained by gene shuffling encodes a polypeptide sequence comprising any one or more of the motifs or domains as defined herein.

Furthermore, nucleic acid variants may also be obtained by site-directed mutagenesis. Several methods are available to achieve site-directed mutagenesis, the most common being PCR based methods (Current Protocols in Molecular Biology, Wiley Eds.).

Nucleic acid sequences encoding Remorin polypeptides may be derived from any natural or artificial source. The nucleic acid sequence may be modified from its native form in composition and/or genomic environment through deliberate human manipulation. Preferably the Remorin polypeptide-encoding nucleic acid sequence is from a plant, further preferably from a dicotyledonous plant, more preferably from the family Brassicaceae, most preferably from *Arabidopsis thaliana*.

Performance of the methods of the invention gives plants having enhanced yield-related traits relative to control plants. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having enhanced yield-related traits relative to control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for enhancing yield-related traits of plants relative to control plants, which method comprises increasing expression in a plant of a nucleic acid sequence encoding a Remorin polypeptide as defined herein. Preferably, an enhanced yield-related trait is one or more of: (i) increased seed fill rate; (ii) increased total seed yield per plant; (iii) increased number of filled seeds; (iv) increased total number of seeds; (v) increased thousand kernel weight (TKW) or (vi) increased harvest index.

Since the transgenic plants according to the present invention have enhanced yield-related traits, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises increasing expression in a plant of a nucleic acid sequence encoding a Remorin polypeptide as defined herein.

An increase in yield and/or growth rate occurs whether the plant is under non-stress conditions or whether the plant is exposed to various stresses compared to control plants grown under comparable conditions. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, nematodes, fungi and insects.

In particular, the methods of the present invention may be performed under non-stress conditions or under conditions of mild drought to give plants having enhanced yield-related traits relative to control plants grown under comparable conditions. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions enhanced yield-related traits relative to control plants grown under comparable conditions. Therefore, according to the present invention, there is provided a method for enhancing yield-related traits in plants grown under non-stress conditions or under mild drought conditions, which method comprises increasing expression in a plant of a nucleic acid sequence encoding a Remorin polypeptide as defined above.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a Remorin polypeptide. Nutrient deficiency may result from a lack of nutrients such as nitrogen, phosphates and other phosphorous-containing compounds, potassium, calcium, cadmium, magnesium, manganese, iron and boron, amongst others.

The present invention encompasses plants, plant parts (including seeds), and plant cells obtainable by the methods according to the present invention. The plants, plant parts or plant cells comprise a nucleic acid transgene encoding a Remorin polypeptide as defined above.

The invention also provides genetic constructs and vectors to facilitate introduction and/or expression in plants of nucleic acid sequences encoding Remorin polypeptides. The gene constructs may be inserted into vectors, which may be commercially available, suitable for transforming into plants and suitable for expression of the gene of interest in the transformed cells. The invention also provides use of a construct as defined herein in the methods of the invention.

More specifically, the present invention provides a construct comprising:
(a) a nucleic acid sequence encoding a Remorin polypeptide as defined above;
(b) one or more control sequences capable of driving expression of the nucleic acid sequence of (a); and optionally
(c) a transcription termination sequence.

The term "control sequence" and "termination sequence" are as defined herein. In one embodiment, the control sequence is a constitutive promoter, preferably one of: (i) a GOS2 promoter; or (ii) a high mobility group B (HMGB) promoter.

Plants are transformed with a vector comprising any of the nucleic acid sequences described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. A constitutive promoter is particularly useful in the methods of the invention. It should be clear that the applicability of the present invention is not restricted to the nucleic acid sequence encoding a Remorin polypeptide, as represented by SEQ ID NO: 198, nor is the applicability of the invention restricted to expression of a nucleic acid sequence encoding a Remorin polypeptide, when driven by a constitutive promoter.

The constitutive promoter is preferably one of: (i) a GOS2 promoter; or (ii) a high mobility group B (HMGB) promoter. See Table 2 in the "Definitions" section herein for further examples of constitutive promoters. Further preferably the GOS2 promoter is from rice, more preferably substantially similar to the GOS2 promoter as represented by SEQ ID NO: 329, most preferably the GOS2 promoter is as represented by SEQ ID NO: 329 or SEQ ID NO: 39. Further preferably the HMGB promoter is from rice, more preferably substantially similar to the HMGB promoter as represented by SEQ ID NO: 330, most preferably the HMGB promoter is as represented by SEQ ID NO: 330 or SEQ ID NO: 331.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acid sequences, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid sequence encoding a Remorin polypeptide as defined hereinabove.

More specifically, the present invention provides a method for the production of transgenic plants having enhanced yield-related traits relative to control plants, which method comprises:
(i) introducing and expressing in a plant, plant part or plant cell a nucleic acid sequence encoding Remorin polypeptide; and
(ii) cultivating the plant cell under conditions promoting plant growth and development.

The nucleic acid of (i) may be any of the nucleic acids capable of encoding a Remorin polypeptide as defined herein.

The nucleic acid sequence may be introduced directly into a plant cell or into the plant itself (including introduction into a tissue, organ or any other part of a plant). According to a preferred feature of the present invention, the nucleic acid sequence is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant.

To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis or quantitative PCR, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell, or plant part, or plant produced by any of the methods described herein, and to all plant propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid sequence encoding a Remorin polypeptide as defined hereinabove. Preferred host cells according to the invention are plant cells. Host plants for the nucleic acid sequences or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

Methods for increasing expression of nucleic acid sequences or genes, or gene products, are well documented in the art and examples are provided in the definitions section.

As mentioned above, a preferred method for increasing expression of a nucleic acid sequence encoding a Remorin polypeptide is by introducing and expressing in a plant a nucleic acid sequence encoding a Remorin polypeptide; however the effects of performing the method, i.e. enhancing yield-related traits, may also be achieved using other well known techniques, including but not limited to T-DNA activation tagging, TILLING, homologous recombination. A description of these techniques is provided in the definitions section.

The present invention also encompasses use of nucleic acid sequences encoding Remorin polypeptides as described herein and use of these Remorin polypeptides in enhancing yield-related traits in plants relative to control plants. Preferably, enhanced yield-related traits is increased yield, more preferably increased seed yield, most preferably the increased seed yield comprises one or more of: (i) increased seed fill rate; (ii) increased total seed yield per plant; (iii) increased number of filled seeds; (iv) increased total number of seeds; (v) increased thousand kernel weight (TKW) or (vi) increased harvest index.

The invention also provides hitherto unknown Remorin-encoding nucleic acids and Remorin polypeptides.

According to a further embodiment of the present invention, there is therefore provided an isolated nucleic acid molecule selected from:
(i) a nucleic acid represented by SEQ ID NO: 332;
(ii) the complement of a nucleic acid represented by SEQ ID NO: 332;
(iii) a nucleic acid encoding a Remorin polypeptide having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 333 and having in increasing order of preference at least 50%, 55%, 60%, 65%, 70%, 75%, 80%, 85%, 90%, 95%, 96%, 97%, 98%, 99% or more sequence identity to SEQ ID NO: 334 (VKKEEVETKVTAWQTAEVAKINNRFKREDVVINGWETEQVEKASAWLKKIER KLDEQRAKALEKTQNDIAKARRKAEEKRASAEAKRGLKLAKVLELANFMKAVG RVPTKR, which matches to the C-terminal region of SEQ ID NO: 326).

According to a further embodiment of the present invention, there is also provided an isolated polypeptide selected from:
(i) an amino acid sequence represented by SEQ ID NO: 333;
(ii) an amino acid sequence having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 333, and having in increasing order of preference at least 50%, 55%, 60%, 65%, 70%, 75%, 80%, 85%, 90%, 95%, 96%, 97%, 98%, 99% or more sequence identity to SEQ ID NO: 334 (VKKEEVETKVTAWQTAEVAKINNRFKREDVVINGWETEQVEKASAWLKKIER KLDEQRAKALEKTQNDIAKARRKAEEKRASAEAKRGLKLAKVLELANFMKAVG RVPTKR, which matches to the C-terminal region of SEQ ID NO: 326);
(iii) derivatives of any of the amino acid sequences given in (i) or (ii) above.

Nucleic acid sequences encoding Remorin polypeptides described herein, or the Remorin polypeptides themselves, may find use in breeding programmes in which a DNA marker is identified, which may be genetically linked to a gene encoding a Remorin polypeptide. The genes/nucleic acid sequences or the Remorin polypeptides themselves may be used to define a molecular marker. This DNA or protein marker may then be used in breeding programmes to select plants having enhanced yield-related traits as defined hereinabove in the methods of the invention.

Allelic variants of a gene/nucleic acid sequence encoding a Remorin polypeptide may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give enhanced yield-related traits. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acid sequences encoding Remorin polypeptides may also be used as probes for genetically and physically mapping the genes that they are a part of, and as markers for traits linked to those genes. Such information may be useful in plant breeding in order to develop lines with desired phenotypes. Such use of nucleic acid sequences encoding a Remorin polypeptide requires only a nucleic acid sequence of at least 15 nucleotides in length. The nucleic acid sequences encoding a Remorin polypeptide may be used as restriction fragment length polymorphism (RFLP) markers. Southern blots (Sambrook J, Fritsch EF and Maniatis T (1989) Molecular Cloning, A Laboratory Manual) of restriction-digested plant genomic DNA may be probed with nucleic acid sequences encoding the Remorin polypeptide. The resulting banding patterns may then be subjected to genetic analyses using computer programs such as MapMaker (Lander et al. (1987) Genomics 1: 174-181) in order to construct a genetic map. In addition, the nucleic acid sequences may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid sequence encoding the Remorin polypeptide in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acid sequences. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits relative to control plants, as described hereinbefore. This trait may also be combined with other economically advantageous traits, such as further yield-enhancing traits, tolerance to other abiotic and biotic stresses, traits modifying various architectural features and/or biochemical and/or physiological features.

V. DREB

Surprisingly, it has now been found that by reducing or substantially eliminating the expression of an endogenous DREB gene and/or the level and/or the activity of a DREB protein in a plant gives plants having increased yield compared to control plants. The present invention therefore provides methods for increasing yield of a plant relative to control plants, comprising reducing or substantially eliminating the expression of an endogenous DREB gene and/or the level and/or the activity of a DREB protein.

The choice of a control plants is a routine part of an experimental setup and may include corresponding wild type plants or corresponding plants in which there is no modulation (mediated by human intervention) of the expression of an endogenous DREB gene and/or the level and/or the activity of a DREB protein.

Advantageously, performance of the methods according to the present invention results in plants having increased yield relative to control plants. In particular performance of the methods of the invention gives plants having increased yield, especially increased seed yield relative to control plants. The terms "yield" and "seed yield" are described in more detail in the "definitions" section herein.

The term "increased yield" as defined herein is taken to mean an increase (in amount) in one or more harvestable parts of a plant which may include biomass (weight), whether aboveground parts and/or parts below ground.

In particular, such harvestable parts include vegetative biomass and/or seeds, and performance of the methods of the invention results in plants having increased yield (in vegetative biomass and/or seed) relative to the yield of control plants.

An increase in the number of seeds may be the result of having more tillers per plant and/or more inflorescence (panicles) per tiller or per plant and/or more flowers per panicle or per plant. The increase may be due to a lower flower/embryo abortion and/or an increase in fertilization efficiency and/or due to improved seed filing.

An increase in seed yield may also be manifested as an increase in seed size and/or seed volume. This may increase the amount, or change the composition of, substances in the seed, such as oils, proteins and carbohydrates. Furthermore, an increase in seed yield may also manifest itself as an increase in seed area and/or seed length and/or seed width and/or seed perimeter. Increased yield may also result in modified architecture, or may occur because of modified architecture.

Taking corn as an example, a yield increase may be manifested as one or more of the following: increase in the number of plants per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

According to a preferred feature, performance of the methods of the invention result in plants having increased yield, particularly increased number of panicles and/or seed yield. Therefore, according to the present invention, there is provided a method for increasing plant seed yield and/or increased number of panicles, which method comprises reducing or substantially eliminating the level of activity of a DREB protein, preferably by downregulating expression of a DREB gene.

Since the transgenic plants according to the present invention have increased yield, it is likely that these plants exhibit an increased growth rate (during at least part of their life cycle), relative to the growth rate of control plants at a corresponding stage in their life cycle. The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early (seedling) vigour, growth rate, flowering time and speed of seed maturation. An increase in growth rate may take place at one or more stages in the life cycle of a plant or during substantially the whole plant life cycle. Increased growth rate during the early stages in the life cycle of a plant may reflect enhanced (seedling) vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soy bean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Performance of the methods of the invention gives plants having an increased growth rate and/or increased seedling vigour. Therefore, according to the present invention, there is provided a method for increasing the growth rate of plants and/or seedling vigour relative to control plants, which method comprises preferentially reducing and/or substantially eliminating the expression of an endogenous DREB gene and/or the level and/or the activity of an endogenous DREB gene in a plant.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, nematodes, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a DREB polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a DREB polypeptide. Nutrient deficiency may result from a lack of nutrients such as nitrogen, phosphates and other phosphorous-containing compounds, potassium, calcium, cadmium, magnesium, manganese, iron and boron, amongst others.

The above-mentioned growth characteristics may advantageously be modified in any plant.

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprise the gene/nucleic acid of interest.

According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, triticale, rye, sorghum, emmer, spelt, secale, einkorn, teff, milo and oats.

The endogenous DREB protein relevant to the invention refers to a protein comprising a single AP2 domain, which is capable of binding to a DRE (dehydration response element) element comprised in a promoter or a fragment thereof.

Typically, the DREB proteins comprise in addition to the AP2 domain a number of characteristic conserved motifs, namely CMIII-1 to CMIII-4 and/or CMIV-1 and CMIV-2, as described by Sakuma et al. 2002 (Biochemical and Biophysical Research Communications (2002), 290, 3, 998-1009). Additionally the DREB protein may contain a nuclear localization signal, which functions in directing the protein to the nucleus. Nuclear localization has been described for example for the OsDREB1L protein (identical to SEQ ID NO: 336) (Chen et al. 2003 Theor. Appl. Genet. 107:972-979).

Further the DREB proteins, when analysed in a phylogenetic tree of AP2 proteins tend to cluster together in a distinct clade apart of clades comprising AP2 proteins belonging to other subfamilies, such as the Apetala 2, RAV or ERF subfamilies. The phylogenetic relationship between AP2 proteins has been extensively reported (Shigyo et al. Gene 366 (2006) 256-265; Nakano et al. 2006; Dubouzet et al. 2003). Methods to perform analysis of the phylogenetic relationship of DREB proteins are well known in the art. Typically, protein sequences are aligned using one of the many methods available such as CLUSTAL X or that provided in the Align AlignX from the Vector NTI (Invitrogen). Taken as input the alignment, a tree is built using algorithms such as those provided in Vector NTI (Invitrogen) or in the PHYLIP package or in MOLPHY version 2.3b3 (Adachi and Hasegawa, 1996). The maximum-likelihood tree is built. The likelihoods of trees can be calculated for example using for example ProtML program under the JTT model, and the trees can sorted according to their Akaike information criterion (AIC) values (Adachi and Hasegawa, 1996). The local bootstrap probability of each branch can be estimated by using the resampling-of-estimatedlog-likelihood (RELL) method (Kishino et al., 1990; Hasegawa and Kishino, 1994). An example of a phylogentic tree of AP2 proteins showing the distinct Glade in which the DRE proteins cluster is shown in FIG. 25. Preferably the DREB protein useful in the methods of the invention clusters within the group of NP_567719.

The AP2 domain is well known to a person skill in the art, and described extensively in databases such as pfam, interpro and smart (Bateman et al., Nucleic Acids Research 30(1): 276-280 (2002); Mulder et al., (2003) Nucl. Acids. Res. 31, 315-318; Letunic et al. (2006) Nucleic Acids Res 34, D257-D260). The sequence ".a+GVp.+.hG.+W.ucltcs . . . ttclaL-GoFsot-tAAhAYD.AAhhhhG . . . pAhhNFs . . . tt" (SEQ ID NO: 340) represents a consensus sequence of an AP2 domain as provided in the SMART database. The accession number for the AP2 domain in the SMART database is SM00380. The amino acid groupings used in the abbreviations are given in Table 4. Gaps and insertions, typically up to 5 amino acids, may be allowed. The AP2 domain is around 60-70 amino acids in length and has DNA binding activity (Ohme-takagi and Shinshi; Plant Cell 1995; 7:173-182). It for example binds to the GCC-box present in promoters of pathogenesis-related proteins (Liu et al. 2006. FEBS Lett. 580(5): 1303-8).

TABLE 4

Code of the amino acid grouping used in the AP2 consensus sequence (SEQ ID NO: 340). "Class" refers to the amino acid classification, "key" denotes the code used for a class, "residues" indicate the amino acids falling within in a given class.

| Class | Key | Residues |
| --- | --- | --- |
| alcohol | o | S, T |
| aliphatic | I | I, L, V |
| any | . | A, C, D, E, F, G, H, I, K, L, M, N, P, Q, R, S, T, V, W, Y |
| aromatic | a | F, H, W, Y |
| charged | c | D, E, H, K, R |
| hydrophobic | h | A, C, F, G, H, I, K, L, M, R, T, V, W, Y |
| negative | − | D, E |
| polar | p | C, D, E, H, K, N, Q, R, S, T |
| positive | + | H, K, R |
| small | s | A, C, D, G, N, P, S, T, V |
| tiny | u | A, G, S |
| turnlike | t | A, C, D, E, G, H, K, N, Q, R, S, T |

Methods to identify an AP2 domain are described herein. Example 49 provides further details on such methods. The DREB protein relevant to the invention comprises an AP2 (DNA-binding) domain having in increasing order of preference at least 50%, 55%, 60%, 65%, 70%, 75%, 80%, 85%, 90%, 95% or more sequence identity to the domain as represented by SEQ ID NO: 340 or SEQ ID NO: 341.

DREB proteins can bind to the cis elements present in the promoters of stress responsive genes as represented by the DRE (dehydration-responsive element), CRT (C-repeat) and LTRE (low temperature responsive element) elements. The nucleic acid sequence TACCGACAT represents the DRE element, wherein the CCGAC core motif is also comprised in CRT and LTRE motifs as present in promoters of *Arabidopsis thaliana* stress genes. DREB proteins specifically bind to six nucleotides as represented by (G/a)(C/t)CGAC (SEQ ID NO: 342) within the DRE element. A person skill in the art will be able to readily identify DRE/CRT/LTRE motif in a polynucleotide sequence using standard bioinformatics and molecular tools. Protein-DNA binding of DREB proteins to DRE/CRT/LTRE motif may be assayed in vivo, for example in a one-hybrid screen, or in vitro, using gel mobility shift assays. These methods are well known and described in the art (Xue, Biochim Biophys Acta. (2002) 1577(1):63-72; Hao D, et al. Biochemistry. 2002 Apr. 2; 41(13):4202-8; Dubouzet et al. 2003); Qin et al. 2004 August; 45(8):1042-52).

The DREB protein relevant to the invention is capable of binding to a DNA molecule comprising the DRE element as represented by SEQ ID NO: 342.

AP2/ERF proteins have been classified based on the presence of conserved motifs in their amino acid sequence. DREB proteins useful in the methods of the present invention fall within the subgroups A-1 and A-2 of the AP2/ERF transcription factors as defined by Sakuma et al. 2002 (Biochemical and Biophysical Research Communications, 290, 998-1009) or alternatively within groups IIIc, IVa and IVb according to the classification of Nakano et al., 2006 (Plant Phys.140, 411-432).

According to Nakamo et al. 2006, the *Arabidopsis thaliana* DREB proteins in group 111c comprise in addition to an AP2 domain, a number of conserved motifs, namely CMII-1 to CMIII-4. CMIII-1 can be represented by the sequence PEL-AWSLPRPESTSPKDIQAAAAEAAAMF (SEQ ID NO: 343), CMII-2 by QSCGAFFMDEEAMLGMPNLLAN-MAEGMLLPPP (SEQ ID NO: 344), CMIII-3 by DYDPT-LAESCPKKPAGRKKFR (SEQ ID NO: 345), and CMIII-4 by LWSY (SEQ ID NO: 346; adapted from Nakano et al 2006). Motifs CMIII-2 and CMIII-4, typically are localized to the C-terminal region. Motifs CMIII-2 and CMIII-4 are comprised within a 98 amino acid C-terminal portion of the *Arabidopsis thaliana* CBF1/DREB1B proteins which has reportedly been shown to function as a transactivation domain (Wang et al., 2005, Plant Mol Biol 58: 543-559).

CMIII-3 motif refers to the highly conserved regions found on both sides of the AP2/ERF. The presence of conserved sequences in these two regions, PKK/RPAGRxKFxETRHP (region I) wherein X represents be any amino acid (SEQ ID NO: 347), and DSAWR (region II) (SEQ ID NO: 348), is conserved in DREB proteins of several plant species (Jaglo et al., 2001, Plant Physiol 127: 910-917; Haake et al., 2002 Plant Physiol 130: 639-648).

DREB proteins belonging to group IV according to Nakano et al. 2006 comprise motifs CMIV-1 and CMIV-2 as represented by the conserved sequence K/RGKGGPxN (SEQ ID NO: 349), and KKRKRRGGRDVAEILKKWKEY-NEQVEADSCIDGGGPKKIRK (SEQ ID NO: 350), respectively, wherein X may be any amino acid. The CMIV-2 motif includes a putative nuclear localization signal (Liu et al., 1998).

Typically, the presence of at least one conserved motif identical or sufficiently homologous to motifs CMIII-1 to CMIII-4, region I and II, motifs CMIV-1 and CMIV-2 in a polypeptide comprising an AP2 domain should be sufficient to identify any query sequence as a DREB protein, however the presence of at least PKK/RPAGRxKFxETRHP (region I) and DSAWR (region II) is preferred.

The consensus sequence provided for the conserved motifs is based mostly on sequences of DREB proteins of *Arabidopsis thaliana*. A person skilled in the art would be well aware that the consensus sequence may vary somewhat, including by deletion or insertion of amino acids, if further or different sequences (for example sequences from other organism) were used for comparison. Preferably, the conserved sequence of CMIII-1 to CMIII-4 and motifs CMIV-1 and CMIV-2 is in increasing order of preference at least 50%, 55%. 60%, 65%, 70%, 75%, 80%, 85%, 90% or 95% identical to any of the conserved motifs CMIII-1 to CMIII-4, CMIV-1 and CMIV-1. Most preferably the conserved motifs are those present in the rice protein OsDREB1A or Os09g0522200, as represented in FIG. 23.

Preferably the DREB protein relevant to the invention comprises:
  (i) An AP2 DNA-binding domain having in increasing order of preference at least 50%, 55%, 60%, 65%, 70%, 75%, 80%, 85%, 90%, 95% or more sequence identity to SEQ ID NO: 340 or SEQ ID NO: 341 and
  (ii) One or more conserved motifs having in increasing order of preference at least 50%, 55%, 60%, 65%, 70%, 75%, 80%, 85%, 90%, 95% or more sequence identity to anyone of SEQ ID NO: 343 to SEQ ID NO: 350.

Even more preferred the DREB protein useful in the methods of the present invention comprises
  (i) An AP2 DNA-binding domain having in increasing order of preference at least 50%, 55%, 60%, 65%, 70%, 75%, 80%, 85%, 90%, 95% or more sequence identity to SEQ ID NO: 340 or SEQ ID NO: 341 and
  (ii) One or more conserved motifs having in increasing order of preference at least 50%, 55%, 60%, 65%, 70%, 75%, 80%, 85%, 90%, 95% or more sequence identity to anyone of SEQ ID NO: 343 to SEQ ID NO: 348.

Examples of DREB proteins and of DREB genes useful in the methods of the invention are provided in Example 46.

Further preferred the DREB protein relevant to the invention comprises a sequence having in increasing order of preference at least 50%, 55%, 60%, 65%, 70%, 75%, 80%, 85%, 90%, 95% or more sequence identity to any of the amino acid sequences given in Example 46. Most preferably, the DREB protein has any of the sequences given in Example 46, most preferably as given in SEQ ID NO: 336.

Reference herein to a "reduction or substantial elimination" of the expression of an endogenous DREB gene in a plant is taken to mean a reduction or a decrease in the DREB gene transcription and/or in the level and/or concentration of the DREB mRNA when compared to control plants. This reduction or substantial elimination may result in reduced or decreased or substantially abolished DREB mRNA activity in a plant. The decrease, reduction or substantial elimination is in increasing order of preference at least 10%, 20%, 30%, 40% or 50%, 60%, 70%, 80%, 85%, 90%, or 95%, 96%, 97%, 98%, 99% or more compared to control plants.

Reference herein to a "reduction" in level of an endogenous DREB protein in a plant is taken to mean a reduction or a decrease in DREB protein level and/or protein concentration or substantial elimination of an endogenous DREB protein relative to endogenous DREB protein levels found in control plants. This reduction or substantial elimination may result in reduced or substantially abolished DREB protein activity in a plant. The decrease, reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

Reference herein to a "reduction" in activity of an endogenous DREB protein in a plant is taken to mean a reduction or a decrease in DREB protein activity and/or substantial elimination of activity of an endogenous DREB protein relative to endogenous DREB protein activity levels found control plants. The decrease, reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

Preferably, the reduction in endogenous DREB protein level and/or activity is obtained by downregulating the expression of the endogenous DREB gene.

Reference herein to an "endogenous" DREB gene refers to DREB genes as found in a plant in its natural form (i.e., without there being any human intervention). The "reduction or substantial elimination" of expression of the DREB gene and/or the level and/or the activity of the DREB protein relevant to the invention may also affect a DREB transgene, that is, an isolated DREB gene subsequently introduced into a plant. Performance of the methods of the invention on a transgenic plant containing a DREB transgene results in reduction or substantial elimination of the expression of the DREB endogenous gene and/or transgene, and/or in reduction or substantial elimination of the level and/or the activity of the DREB protein compared to control plants.

In a preferred embodiment the reduction or substantial elimination of expression of an endogenous DREB gene and/or level and/or activity of a DREB protein is obtained by introducing an DREB nucleic acid or fragment thereof substantially homologous to a DREB gene, more preferably said isolated nucleic acid is capable of forming a hairpin structure, further preferably the isolated nucleic acid is under the control of a constitutive promoter.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including introns, the 5' and/or 3' UTR (untranslated region), either in part or in whole). The stretch of substantially contiguous nucleotides may be derived from SEQ ID NO: 335, or from any of the nucleic acid sequences given in Example 1, or from any nucleic acid capable of encoding a homologue (orthologue or paralogue, the terms "orthologue" and "paralogue" being as defined herein) of any one of the amino acid sequences given in Example 46. A nucleic acid sequence encoding a (functional) polypeptide is not a requirement for the various methods discussed herein for the reduction or substantial elimination of expression of an endogenous gene.

This reduction (or substantial elimination) of endogenous DREB gene expression may be achieved using any one or more of several well-known gene silencing methods. "Gene silencing" or "downregulation" of expression, as used herein, refers to a reduction or the substantial elimination of DREB gene expression and/or DREB protein levels and/or DREB protein activity. A description of techniques for downregulating expression may be found in the definitions section.

One such method for reduction or substantial elimination of endogenous DREB gene expression is RNA-mediated downregulation of gene expression (RNA silencing). Silencing in this case is triggered in a plant by a double stranded RNA molecule (dsRNA) that is substantially homologous to a target DREB gene. This dsRNA is further processed by the plant into about 21 to about 26 nucleotides called short interfering RNAs (siRNAs). The siRNAs are incorporated into an RNA-induced silencing complex (RISC) that cleaves the mRNA of a DREB target gene, thereby reducing or substantially eliminating the number and/or reducing the concentration of DREB mRNAs to be translated into a DREB protein. The siRNAs of the invention have sequences corresponding to fragments of about 21 substantially contiguous nucleotides across the entire sequence of the target gene. Preferably the siRNAs useful in the invention derived from the target gene as set forth in SEQ ID NO: 335 may comprise a multiplicity of RNA molecules which are selected from the group consisting of oligonucleotides substantially identical to any given contiguous 18 to 26 nucleotides of SEQ ID NO: 335.

dsRNA containing a nucleotide sequence identical or substantially homologous to a portion of the target gene is preferred for achieving the reduction or substantial elimination of the DREB gene expression. However, the invention has the advantage of being able to tolerate sequence variations that might be expected due to genetic mutation, strain polymorphism, or evolutionally divergence. RNA sequences with insertions, deletions, and single point mutations relative to the target sequence may also be effective for reduction. Greater than 90%, 92%, 94%, 96%, 98% sequence identity, or even up to 100% sequence identity, between the siRNA and the DREB gene is preferred. Alternatively, the duplex region of the RNA may be defined functionally as a nucleotide sequence that is capable of hybridizing with a portion of the target gene transcript under stringent conditions (e.g. 400 mM NaCl, 40 mM PIPES pH 6.4, 1 mM EDTA, at 60 C Celsius for 12-16 h; followed by washing). The length of the substantially identical double-stranded nucleotide sequence may be at least about 21 (including at least 15), 25, 50, 100, 200, 300, 400, 500, or more up to the total length of the targeted DREB gene. In a preferred embodiment, the length of the double-stranded nucleotide sequence is from approximately about 21 (at least 15) to about 400 or 500 nucleotides in length, and it is equal or shorter to the total length of the targeted DREB gene.

One example of an RNA silencing method involves the introduction of gene sequences or parts thereof in a sense orientation into a plant. "Sense orientation" refers to DNA that is homologous or it corresponds to an mRNA transcript thereof. Introduced into a plant would therefore be at least an additional copy (in full or in part) of a DREB gene already present in the host plant. The additional gene, or part thereof, will silence an endogenous DREB gene, giving rise to a phenomenon known as co-suppression. The reduction of DREB gene expression will be more pronounced if several additional copies are introduced into the plant, as there is a positive correlation between high transcript levels and the triggering of co-suppression.

Another example of an RNA silencing method involves the use of antisense DREB nucleic acid sequences. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. Accordingly, an antisense nucleic acid can hybridize to a sense nucleic acid. The antisense nucleic acid can be complementary to an entire DREB coding strand or only to a portion thereof. Antisense nucleic acids can be designed according to the rules of Watson and Crick base pairing. The antisense nucleic acid molecule may be antisense to a "coding region" or antisense to a "non-coding region" of the transcribed mRNA or premRNA of the DREB gene. The term "coding region" refers to the region of the nucleotide sequence comprising codons that are translated into amino acid residues. The term "non-coding region" refers sequences in a gene or its transcribed RNA that fall outside of the coding regions. Such non-coding regions may comprise at least in part, any of the 5' leader, 3' UTR (untranslated region) and introns.

The antisense nucleic acid molecule may be complementary to the entire coding region of DREB mRNA, but is preferably an oligonucleotide which is antisense to only a portion of the coding or non-coding region of DREB mRNA. For example, the antisense oligonucleotide may be complementary to the region surrounding the translation start site of DREB mRNA. The length of a suitable antisense oligonucleotide would be known in the art and may start from about 20 nucleotides in length or less. An antisense nucleic acid of the invention can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid are well known in the art.

Known nucleotide modifications include methylation, cyclization and 'caps' and substitution of one or more of the naturally occurring nucleotides with an analogue such as inosine. Other modifications of nucleotides are well known to a person skilled in the art.

Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection). Preferably, production of antisense nucleic acids in plants occurs by means of a stably integrated transgene comprising a promoter operative for preferential expression in endosperm tissue plants, an antisense oligonucleotide, and a terminator.

This reduction or substantial elimination of expression may be achieved using routine tools and techniques. A preferred method for the reduction or substantial elimination of endogenous gene expression is by introducing and expressing in a plant a genetic construct into which the nucleic acid useful in the methods of the invention is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid useful in the methods of the invention or a part thereof preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric DREB RNA with a self-complementary structure is formed (partial or complete). This double-stranded RNA structure is referred to as the hairpin RNA (hpRNA). The hpRNA is processed by the plant into siRNAs that are incorporated into a RISC. The RISC further cleaves the mRNA of a DREB target gene, thereby reducing or substantially eliminating the number of DREB mRNAs to be translated into a DREB protein. See for example, Grierson et al. (1998) WO 98/53083; Waterhouse et al. (1999) WO 99/53050).

The nucleic acid molecules used for silencing in the methods of the invention (whether introduced into a plant or generated in situ) hybridize with or bind to cellular mRNA and/or a genomic DNA region comprising a DREB gene to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Antisense nucleic acid molecules may be introduced into a plant by transformation or direct injection at a specific tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies, which bind to cell surface receptors or antigens. The antisense nucleic acid molecules can also be delivered to cells using the vectors described herein.

According to a further aspect, the antisense nucleic acid is an a-anomeric nucleic acid molecule. An a-anomeric nucleic acid molecule forms specific double-stranded hybrids with complementary RNA in which, contrary to the usual b-units, the strands run parallel to each other (Gaultier et al., Nucl. Ac. Res. 15, 6625-6641, 1987). The antisense nucleic acid molecule may also comprise a 2'-o-methylribonucleotide (Inoue et al. Nucl. Ac. Res. 15, 6131-6148, 1987) or a chimeric RNA-DNA analogue (Inoue et al. FEBS Lett. 215, 327-330, 1987).

Artificial and/or natural microRNAs (miRNAs) may be used to reduce gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. miRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in reduced mRNA levels of target genes.

Natural miRNAs are found in nature. But artificial microRNAs (amiRNAs), are equally useful in the methods of the invention. amiRNAs, which are typically 21 or 24 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, Schwab R, et al. 2005 (Dev Cell. (2005) 8(4): 517-27). Convenient tools for design and generation of amiRNAs and their precursors are also available to the public (Schwab et al., 2006 Plant Cell. 2006 18(5): 1121-33).

According to another feature of the invention the reduction or substantial elimination is preferentially effected by using a microRNA (natural or artificial miRNA).

In still another embodiment, an antisense nucleic acid useful in the methods of the invention is a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach, Nature 334, 585-591, 1988)) can be used to catalytically cleave DREB mRNA transcripts to thereby inhibit translation of DREB mRNA. A ribozyme having specificity for a DREB-encoding nucleic acid can be designed based upon the nucleotide sequence of a DREB cDNA. For example, a derivative of a Tetrahymena L-19 IVS RNA can be constructed in which the nucleotide sequence of the active site is complementary to the nucleotide sequence to be cleaved in an DREB-encoding mRNA. See, e.g., Cech et al. U.S. Pat. No. 4,987,071; and Cech et al. U.S. Pat. No. 5,116,742. Alternatively, DREB mRNA can be used to select a catalytic RNA having a specific ribonuclease activity from a pool of RNA molecules. See, e.g., Bartel and Szostak, Science 261, 1411-1418, 1993. The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by gene silencing strategies as described by, among others, Angell and Baulcombe 1998 (Amplicon VIGS WO 98/36083); Baulcombe (WO 99/15682).

Gene silencing may also occur if there is a mutation on the endogenous DREB gene and/or a mutation on an isolated DREB gene subsequently introduced into a plant. For example, a method to introduce such mutation may be EMS (Ethylmethane Sulphonate) treatment. The reduction or substantial elimination of DREB protein activity may be caused by a non-functional DREB protein. For example, DREB can bind to various interacting proteins; one or more mutation(s) may therefore provide for a DREB protein that is still able to bind interacting proteins but that cannot exhibit its normal function as transcription factor.

A further approach to gene silencing is by targeting nucleotide sequences complementary to the regulatory region of the DREB gene (e.g., the DREB promoter and/or enhancers) to form triple helical structures that prevent transcription of the DREB gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Still another approach to gene silencing is described by Hiratsu et al. (Plant J. 34, 733-739, 2003). This method does not depend on sequence homology to the targeted gene but involves the use of a repression sequence domain in transcriptional gene fusions, and has been used to modify traits of agronomic interest (Fujita et al., Plant Cell 17, 3470-3488, 2005 and Mitsuda at al., Plant Cell 17, 2993-3006, 2005). Typically, a nucleotide chimeric fusion is made between a gene encoding a protein capable of positively influencing the expression of the targeted gene (such as a transcription activator), and a nucleotide fragment encoding a repression domain. Upon expression of the chimeric gene fusion, the expression of the targeted gene is repressed, usually in a dominant negative fashion, reducing and abolishing the activity of the transcription factor. Repression domains are well known in the art, for example the EAR motif present in some AP2 and Zinc finger transcription factors. Methods based on repression domains are well suited to overcome gene redundancy for the targeted gene in the plant species of choice (Hiratsu et al. Plant J. 2003 June; 34(5):733-9.).

Described above are examples of various methods for gene silencing (for the reduction or substantial elimination of endogenous DREB gene expression and activity of the protein). The methods of the invention rely on the reduction of expression of an endogenous DREB gene in a plant. A person skilled in the art would readily be able to adapt the aforementioned methods for silencing so as to achieve gene silencing in a whole plant or in parts thereof through the use of an appropriate promoter, for example.

It should be noted that the essence of the present invention resides in the advantageous and surprising results found upon reduction or substantial elimination of endogenous DREB gene expression in a plant, and is not limited to any particular method for such reduction or substantial elimination of endogenous DREB protein activity. The activity of a DREB protein may also be reduced or eliminated by introducing a genetic modification (preferably in the locus of a DREB gene). The locus of a gene as defined herein is taken to mean a genomic region, which includes the gene of interest and 10 kb up- or down stream of the coding region.

The genetic modification may be introduced, for example, by any one (or more) of the following methods: T-DNA inactivation, TILLING, site-directed mutagenesis, directed evolution, homologous recombination. Following introduction of the genetic modification, there follows a step of selecting for reduced activity of a DREB protein, which decrease in activity gives plants having increased yield.

T-DNA inactivation tagging involves insertion of a T-DNA, in the genomic region of the gene of interest or 10 kb up- or downstream of the coding region of a gene in a configuration such that the T-DNA inhibits expression of the targeted gene. Typically, regulation of expression of the targeted gene by its natural promoter is disrupted. The T-DNA is randomly inserted into the plant genome, for example, through *Agrobacterium* infection and leads to down-regulated expression of genes near the inserted T-DNA. The resulting transgenic plants show phenotypes due to inhibited expression of genes close to the introduced T-DNA.

A genetic modification may also be introduced in the locus of a DREB gene using the technique of TILLING (Targeted Induced Local Lesions In Genomes). This mutagenesis technology is useful to generate, identify and isolate mutagenised variants of a DREB nucleic acid incapable of exhibiting DREB activity. TILLING also allows selection of plants carrying such mutant variants. These mutant variants may completely lack DREB activity. The principle of TILLING is described in the definitions section.

Site-directed mutagenesis and random mutagenesis may be used to generate variants of DREB nucleic acids. Several methods are available to achieve site-directed mutagenesis, the most common being PCR based methods (current protocols in molecular biology. Wiley Eds.).

Directed evolution may also be used to generate variants of DREB nucleic acids. This consists of iterations of DNA shuffling followed by appropriate screening and/or selection to generate variants of DREB nucleic acids or variants thereof encoding DREB proteins having a modified (here reduced or abolished or eliminated) biological activity (Castle et al., (2004) Science 304(5674): 1151-4; U.S. Pat. Nos. 5,811,238 and 6,395,547).

T-DNA activation, TILLING, site-directed mutagenesis and directed evolution are examples of technologies that enable the generation of novel alleles and DREB variants.

Homologous recombination allows introduction in a genome of a selected nucleic acid at a defined selected position, preferably to the locus of the DREB gene.

Other methods, such as the use of antibodies directed to the endogenous DREB for inhibiting its function in planta, or interference in the signalling pathway in which DREB is involved, will be well known to the skilled man. Alternatively, a screening program may be set up to identify natural variants of a DREB gene, which variants have reduced DREB activity, or no DREB activity at all. Such natural variants may also be used in the methods of the present invention.

For optimal performance, the gene silencing techniques used for the reduction or substantial elimination of endogenous DREB gene expression requires the use of DREB gene sequences from monocotyledonous plants for transformation into monocotyledonous plants. Preferably, a DREB gene sequence from a given plant species is introduced into that same species. For example, a DREB gene sequence from rice (be it a full length DREB sequence or a fragment) is transformed into a rice plant. The DREB gene sequence need not be introduced into the same plant variety.

A "DREB gene" or a "DREB nucleic acid" refers to a deoxyribonucleotide or a ribonucleotide polymer comprising a sequence homologous or corresponding to the transcribed region of a gene encoding a DREB protein. The polymer above mentioned may be of any length, either double- or single-stranded, or analogues thereof, that have the essential characteristic of a natural ribonucleotide in that they can hybridise to nucleic acids in a manner similar to naturally occurring polynucleotides.

The nucleic acid useful in the methods of the inventions refers to a sufficient length of substantially contiguous nucleotides, typically derived from a DREB-protein encoding gene, to perform silencing of a gene encoding a DREB protein; this may be as little as 20 or fewer nucleotides. A gene encoding a (functional) protein is not a requirement for the various methods discussed above for the reduction or substantial elimination of expression of an endogenous DREB gene and/or the level and/or the activity of a DREB protein.

The methods of the invention may be performed using a sufficient length of substantially contiguous nucleotides of a DREB gene/nucleic acid, which may consist of 21 or fewer (typically at least 10) nucleotides, which may be from any part of the DREB gene/nucleic acid, such as the AP2 encoding coding region that is well conserved amongst the DREB gene family, or from any part of the non-encoding regions in the DREB gene.

Genes encoding DREB proteins are well known in the art and useful in the methods of the invention are substantially contiguous nucleotides of the plant DREB genes/nucleic acid described (Qin et al. Plant Cell Physiol. 2004 August; 45(8): 1042-52; Li et al. Theor Appl Genet. 2005 May; 110(8):1355-62; Nakano et al. Plant Physiol. 140, 411-432, 2006 Badawi et al. Mol Genet Genomics. 2007 Feb. 7; Huang et al. J Plant Physiol. 2007 Jan. 13).

Other DREB gene/nucleic acid derived sequences may also be used in the methods of the invention, and may readily be identified by a person skilled in the art. DREB proteins may be identified by the presence of one or more of several well-known features (see above). Upon identification of a DREB protein, a person skilled in the art could easily derive, using routine techniques, the corresponding encoding nucleic acid sequence and use a sufficient length of contiguous nucleotides of the same to perform any one or more of the gene silencing methods described above.

Plant DREB proteins may also be identified by the presence of certain conserved motifs. The presence of these conserved motifs may be identified using methods for the alignment of sequences for comparison as described hereinabove. In some instances, the default parameters may be adjusted to modify the stringency of the search. For example using BLAST, the statistical significance threshold (called "expect" value) for reporting matches against database sequences may be increased to show less stringent matches. Typically the expected value for matches identifying DREB proteins when using Motifs CMIII-1 to CMIII-4 or motifs CMIV-1 and CMIV-2 are lower than e-07, more typically lower than e-10, e-15, e-20, e-25, e-30, e-35, e-40, e-45, e-50 or e-100. In this way, short nearly exact matches may be identified. Upon identification of a DREB protein by the presence of these motifs, a person skilled in the art may easily derive the corresponding nucleic acid encoding the polypeptide comprising the relevant motifs, and use a sufficient length of contiguous nucleotides of the same to perform any one or more of the gene silencing methods described above (for the reduction or substantial elimination of an endogenous DREB gene expression and/or the level and/or the activity of a DREB protein).

Homologues, as defined above, may readily be identified using routine techniques well known in the art, such as by sequence alignment; homologues of DREB proteins may have been named differently in various plant species, therefore the gene/protein names should not be used for identifying orthologues or paralogues. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the alignment of two complete sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information. Homologous sequences may readily be identified using, for example, the ClustalW multiple sequence alignment algorithm (version 1.83) with the default pairwise alignment parameters, and a scoring method in percentage. Minor manual editing may be performed to optimise alignment between conserved motifs (see below), as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

The terms "domain", "signature" and "motif" are defined in the "definitions" section herein. The various structural domains in a DREB protein may be identified using specialised databases e.g. SMART (Schultz et al. (1998) Proc. Natl. Acad. Sci. USA 95, 5857-5864; Letunic et al. (2002) Nucleic Acids Res 30, 242-244; InterPro (Mulder et al., (2003) Nucl. Acids. Res. 31, 315-318; Prosite (Bucher and Bairoch (1994). A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Furthermore, a DREB protein may also be identifiable by its ability to bind DNA and to interact with other proteins. DNA-binding activity and protein-protein interactions may readily be determined in vitro or in vivo using techniques well known in the art. Examples of in vitro assays for DNA binding activity include: gel retardation analysis using known DREB DNA binding domains (Sakuma et al. 2002) or yeast one-hybrid assays (Qin et al. 2004). The activity of a DREB protein may alternatively be determined by measuring the ability to transactivate the expression of a reporter constructs in which a DRE containing promoter drives expression of reporter gene by for example determining the amount or activity of the reporter product produced. One such example is the protoplast system based on a reporter construct comprising the rd29A promoter of *Arabidopsis thaliana* coupled to the UidA gene and subsequent determination of GUS activity (Dubouzet et al. 2003). An example of an in vitro assay for protein-protein interactions is the yeast two-hybrid analysis (Fields and Song (1989) Nature 340:245-6). Proteins known to interact with DREB include the ADA2 and GCN5 Stockinger et al. (Nucleic Acids Res. 2001; 29(7)1524-33). Proteins known to bind to the DREB gene promoters and therefore influence their gene expression include ICE1 (Chinnusamy et al. Genes Dev. 2003 Apr. 15; 17(8):1043-54).

Therefore upon identification of a DREB protein using one or several of the features described above, a person skilled in the art may easily derive the corresponding nucleic acid encoding the polypeptide, and use a sufficient length of substantially contiguous nucleotides of the same to perform any one or more of the gene silencing methods described above (for the reduction or substantial elimination of an endogenous DREB gene expression).

Preferred for use in the methods of the invention is a sufficient length of substantially contiguous nucleotides of SEQ ID NO: 335 (OsDREB1A), or the use of a sufficient length of substantially contiguous nucleotides of a nucleic acid sequence encoding an orthologue or paralogue of OsDREB1A (SEQ ID NO: 335). Examples of such orthologues and paralogues of OsDREB1A protein are provided in Example 46. Preferred homologues of OsDREB1A are the proteins represented by the protein sequences listed in Table Y2.

Orthologues in, for example, monocot plant species may easily be found by performing a so-called reciprocal blast search. This may be done by a first blast involving blasting a query sequence (for example, SEQ ID NO: 335 or SEQ ID NO: 336) against any sequence database, such as the publicly available NCBI database. BLASTN or TBLASTX (using standard default values) may be used when starting from a nucleotide sequence and BLASTP or TBLASTN (using standard default values) may be used when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 335 or SEQ ID NO: 336 the second blast would therefore be against rice sequences). The results of the first and second BLASTs are then compared. A paralogue is identified if a high-ranking hit from the second blast is from the same species as from which the query sequence is derived; an orthologue is identified if a high-ranking hit is not from the same species as from which the query sequence is derived. High-ranking hits are those having a low E-value. The lower the E-value, the more significant the score (or in other words the lower the chance that the hit was found by chance). Percentage identity refers to the number of identical nucleotides (or amino acids) between the two compared nucleic acid (or polypeptide) sequences over a particular length. Computation of the E-value is well known in the art. In the case of large families, ClustalW may be used, followed by a neighbour joining tree, to help visualize clustering of related genes and to identify orthologues and paralogues.

The source of the substantially contiguous nucleotides of a DREB gene/nucleic acid may be any plant source or artificial source. For optimal performance, the gene silencing techniques used for the reduction or substantial elimination of endogenous DREB gene expression requires the use of DREB sequences from monocotyledonous plants for transformation into monocotyledonous plants. Preferably, DREB sequences from the family Poaceae are transformed into plants of the family Poaceae. Further preferably, a DREB gene from rice (be it a full length DREB sequence or a fragment) is transformed into a rice plant. The DREB nucleic acid need not be introduced into the same plant variety. Most preferably, the DREB nucleic acid from rice is a sufficient length of substantially contiguous nucleotides of SEQ ID NO: 335 (OsDREB1A) or a sufficient length of substantially contiguous nucleotides of a nucleic acid sequence encoding an orthologue or paralogue of OsDREB1A (SEQ ID NO: 335). As mentioned above, a person skilled in the art would be well aware of what would constitute a sufficient length of substantially contiguous nucleotides to perform any of the gene silencing methods defined hereinabove, this may be as little as 20 or fewer substantially contiguous nucleotides in some cases.

The invention also provides genetic constructs and vectors to facilitate introduction and/or expression of the nucleotide sequences useful in the methods according to the invention.

Therefore, there is provided a gene construct comprising one or more control sequences capable of driving expression of a sense and/or antisense DREB nucleic acid sequence in a plant so as to silence an endogenous DREB gene in the plant; and optionally a transcription termination sequence. Preferably, the control sequence is a constitutive and ubiquitous promoter.

A preferred construct for gene silencing is one comprising an inverted repeat of a DREB gene or fragment thereof, preferably capable of forming a hairpin structure, which inverted repeat is under the control of a constitutive promoter. Methods of the invention may also be performed using other strategies wherein the level and/or activity of the protein is reduced. Such techniques are known in the art.

Constructs useful in the methods according to the present invention may be created using recombinant DNA technology well known to persons skilled in the art. The gene constructs may be inserted into vectors, which may be commercially available, suitable for transforming into plants and suitable for expression of the gene of interest in the transformed cells. The invention therefore provides use of a gene construct as defined hereinabove in the methods of the invention.

The sequence of interest is operably linked to one or more control sequences (at least to a promoter) capable of increasing expression in a plant. The terms "control sequence" and "promoter" are as defined herein.

Advantageously, any type of promoter may be used to drive expression of the nucleic acid sequence. Preferably, the DREB nucleic acid or functional variant thereof is operably linked to a constitutive promoter. Preferably, the constitutive promoter capable of preferentially expressing the nucleic acid throughout the plant has a comparable expression profile to a GOS2 promoter. More preferably, the constitutive promoter has the same expression profile as the rice GOS2 promoter, most preferably, the promoter capable of preferentially expressing the nucleic acid throughout the plant is the GOS2 promoter from rice (SEQ ID NO: 339 or SEQ ID NO: 39). It should be clear that the applicability of the present invention is not restricted to the DREB nucleic acid represented by SEQ ID NO: 335, nor is the applicability of the invention restricted to expression of a DREB nucleic acid when driven by a GOS2 promoter. An alternative constitutive promoter that is useful in the methods of the present invention is the high mobility group protein promoter (SEQ ID NO: 40 in WO 2004/070039). Examples of other constitutive promoters that may also be used to drive expression of a DREB nucleic acid are shown in the definitions section.

Optionally, one or more terminator sequences may also be used in the construct introduced into a plant. Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The present invention also encompasses plants including plant parts obtainable by the methods according to the present invention having increased yield relative to control plants and which have reduced or substantially eliminated expression of an endogenous DREB gene. Host cells and host plants are taken herein to mean the cells, whole plants or parts thereof which are the recipient of the genetic construct of the invention, typically introduced using transformation techniques.

The invention also provides a method for the production of transgenic plants having increased yield relative to control plants, which transgenic plants have reduced or substantially eliminated expression of an endogenous DREB gene and/or the level and/or the activity of a DREB protein.

More specifically, the present invention provides a method for the production of transgenic plants having increased seed yield which method comprises:
(i) introducing and expressing in a plant, plant part or plant cell a gene construct comprising one or more control sequences capable of preferentially driving expression of a sense and/or antisense DREB nucleic acid sequence in a plant so as to silence expression an endogenous DREB gene in the plant; and
(ii) cultivating the plant, plant part or plant cell under conditions promoting plant growth and development.

Preferably, the construct introduced into a plant is one comprising an inverted repeat (in part or complete) of a DREB gene or fragment thereof, preferably capable of forming a hairpin structure.

According to a preferred feature of the present invention, the construct is introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may be evaluated, for instance using Southern analysis, for the presence of the gene of interest, copy number and/or genomic organisation. Alternatively or additionally, expression levels of the newly introduced DNA may be monitored using Northern and/or Western analysis, or quantitative PCR, all techniques being well known to persons having ordinary skill in the art.

The generated transformed plants may be propagated by a variety of means, such as by clonal propagation or classical breeding techniques. For example, a first generation (or T1) transformed plant may be selfed to give homozygous second generation (or T2) transformants, and the T2 plants further propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also extends to harvestable parts of a plant such as seeds and products derived, preferably directly derived, from a harvestable part of such a plant, such as dry pellets or powders, oil, fat and fatty acids, starch or proteins.

The present invention also encompasses use of DREB nucleic acids for the reduction or substantial elimination of endogenous DREB gene expression and/or level and/or activity of a DREB protein in a plant for increasing plant seed yield as defined hereinabove.

DESCRIPTION OF FIGURES

The present invention will now be described with reference to the following figures in which:

FIG. 1 shows the sequence of SEQ ID NO: 2 (A) and of SEQ ID NO: 27 (B), with the NAP1 domain in bold and underlined.

FIG. 2 shows the binary vector for increased expression in *Oryza sativa* of an *Arabidopsis* NAP1-like protein-encoding nucleic acid under the control of a GOS2 promoter.

FIG. 3 shows a CLUSTAL W multiple sequence alignment of NAP1-like polypeptides from various plant species. SEQ ID NO: 2 (AtNAP1-like, At1g74560) is indicated in bold and the conserved NAP domain is underlined.

FIG. 6 The NAP1-like protein has a nuclear localisation in plants. A) The *Medicago* NAP1-like protein has been shown to be localised in the nucleus of cultured alfalfa cells by indirect immunofluorescence using an antibody raised against the purified protein (left picture of panel A). To confirm the nuclear localisation, the nuclei were stained in parallel with the fluorescent dye DAPI, (right picture of panel A). In the insert the arrow points to a metaphase cell. A faint fluorescence indicates low abundance of the NAP1-like protein around the chromosomes in metaphase cells without a nuclear compartment. B) The transiently expressed *Arabidopsis* NAP1-like protein, fused to GFP, is localised to the nucleus in *Arabidopsis* cells following a PEG-mediated uptake of the gene construct into protoplasts.

FIG. 8 Examples of sequences useful in performing the methods according to the present invention.

FIG. 12 details examples of sequences useful in performing the methods according to the present invention.

FIG. 14 shows a CLUSTAL W multiple sequence alignment of CycH polypeptides from various species. Parameters used were: slow alignment, gap opening 10, gap extension: 0.1, BLOSUM matrix. Conserved amino acids are indicated with a star, conservative substitutions are indicated by a colon, less conserved substitutions are indicated by a dot. Such multiple sequence alignments are useful for defining helix domains in other Cyclin H proteins and for defining suitable truncations to generate $CycH_{Tr}$ polypeptides useful in the methods of the present invention.

FIG. 17 details examples of sequences useful in performing the methods according to the present invention.

FIG. 20 shows a CLUSTAL W (1;83) multiple sequence alignment of the C-terminal Remorin domain of Remorin polypeptides, and of the last C-terminal amino acid residues of the Remorin polypeptides, from various source species. The Remorin domain of SEQ ID NO: 199 is represented by a black box above the polypeptide sequence, and indicated as such. The predicted coiled coil domain of SEQ ID NO: 199 is double-underlined, and a putative sumoylation site is boxed. Additionally, the C-terminal amino acid residues of the Remorin polypeptides usually comprising a at least one Cys and/or one Phe, are boxed across the alignment. Sequences shown are: gi|18410744|ref|NP_567050.1| (SEQ ID NO: 199); gi|6706425|emb|CAB66111.1| (SEQ ID NO: 257); gi|15227454|ref|NP_181718.1| (SEQ ID NO: 233); gi|124360195|gb|ABN08208.1| (SEQ ID NO: 311); gi|115472875|ref|NP_001060036. (SEQ ID NO: 277); gi|102140033|gb|ABF70164.1| (SEQ ID NO: 323); gi|115456099|ref|NP_001051650. (SEQ ID NO: 279); gi|113610699|dbj|BAF21077.1| (SEQ ID NO: 273); gi|23197616|gb|AAN15335.1| (SEQ ID NO: 207); gi|42573455|ref|NP_974824.1| (SEQ ID NO: 211); gi|14423538|gb|AAK62451.1|AF38 (SEQ ID NO: 209); gi|21555669|gb|AAM63910.1|(SEQ ID NO: 201); gi|15229057|ref|NP_190463.1| (SEQ ID NO: 215); gi|6522572|emb|CAB62016.1| (SEQ ID NO: 255); gi|1881585|gb|AAB49425.1| (SEQ ID NO: 307); gi|4731573|gb|AAD28506.11|AF123 (SEQ ID NO: 317); gi|92877744|gb|ABE84731.1| (SEQ ID NO: 321); gi|601843|gb|AAA57124.1| (SEQ ID NO: 205); gi|15225899|ref|NP_182106.1| (SEQ ID NO: 217); gi|15233068|ref|NP_191685.1| (SEQ ID NO: 203); gi|115447549|ref|NP_001047554, (SEQ ID NO: 267); gi|115459618|ref|NP_001053409. (SEQ ID NO: 269); gi|4883530|gb|AAD28507.2|AF123 (SEQ ID NO: 319); gi|1135471931 dbj|BAF10636.1| (SEQ ID NO: 275); gi|115449889|ref|NP_001048576. (SEQ ID NO: 265); gi|7267406|emb|CAB80876.1| (SEQ ID NO: 219); gi|79458120|ref|NP_191976.2| (SEQ ID NO: 223); gi|79320867|ref|NP_001031248.1 (SEQ ID NO: 227); gi|18408804|ref|NP_564900.1| (SEQ ID NO: 229); gi|113536885|dbj|BAF09268.1| (SEQ ID NO: 283); gi|15220725|ref|NP_174322.1| (SEQ ID NO: 241); gi|115460610|ref|NP_001053905. (SEQ ID NO: 291); gi|113649772|dbj|BAF30284.1| (SEQ ID NO: 293); gi|113547257|dbj|BAF10700.1| (SEQ ID NO: 287); gi|115443805|ref|NP_001045682. (SEQ ID NO: 289); gi|27764932|gb|AAO23587.1| (SEQ ID NO: 245); gi|42562741|ref|NP_175789.21 (SEQ ID NO: 239); gi|92884019|gb|ABE87162.1| (SEQ ID NO: 315); gi|113645505|dbj|BAF28646.1| (SEQ ID NO: 295); gi|23928441|gb|AAN40027.1| (SEQ ID NO: 305); gi|83853834|gb|ABC47866.1| (SEQ ID NO: 309); gi|92888879|gb|ABE89592.1| (SEQ ID NO: 313); gi|42571771|ref|NP_973976.11 (SEQ ID NO: 243); gi|113631594|dbj|BAF25275.1| (SEQ ID NO: 299); gi|115476840|ref|NP_001062016. (SEQ ID NO: 301); gi|115448895|ref|NP_001048227. (SEQ ID NO: 303); gi|7270646|emb|CAB80363.1| (SEQ ID NO: 237); gi|12597780|gb|AAG60092.1|AC07 (SEQ ID NO: 249); gi|12325086|gb|AAG52495.1|AC01 (SEQ ID NO: 251); gi|30697834|ref|NP_849866.11 (SEQ ID NO: 225); gi|15222980|ref|NP_172845.1| (SEQ ID NO: 235); gi|115451495|ref|NP_001049348. (SEQ ID NO: 281); gi|113638961|dbj|BAF26266.1| (SEQ ID NO: 297); gi|15240195|ref|NP_200936.1| (SEQ ID NO: 231); gi|113537166|dbj|BAF09549.1| (SEQ ID NO: 285); gi|92883543|gb|ABE86981.1| (SEQ ID NO: 325).

FIG. 22 details examples of sequences useful in performing the methods according to the present invention.

FIG. 24 shows an alignment of the amino acid sequences of DREB proteins from rice and *Arabidopsis thaliana*. A consensus sequence is shown. Additional sequences shown are: Os01g0968800 (SEQ ID NO: 417); Os02g0677300 (SEQ ID NO: 362); Os06g0127100 (SEQ ID NO: 364); Os06g0165600 (SEQ ID NO: 358); Os08g0545400 (SEQ ID NO: 356); Os08g0545500 (SEQ ID NO: 352); Os09g0522000 (SEQ ID NO: 360); Os09g0522100 (SEQ ID NO: 354); Os09g0522200 (SEQ ID NO: 336); At1g46768 (SEQ ID NO: 418); AT1G78080 (SEQ ID NO: 419); At2g40220 (SEQ ID NO: 420); At3g11020 (SEQ ID NO: 421); At4g25480 (SEQ ID NO: 422); AT4G25490 (SEQ ID NO: 423); At5g05410 (SEQ ID NO: 424); At5g25810 (SEQ ID NO: 425); At4g25470 (SEQ ID NO: 426); At4g36900 (SEQ ID NO: 427).

FIG. 27 details examples of sequences useful in performing the methods according to the present invention, or useful in isolating such sequences. Sequences may result from public EST assemblies, with lesser quality sequencing. As a consequence, a few nucleic acid substitutions may be expected. The start (ATG) and stop codons delimit the nucleic acid sequences when these encode full-length DREB proteins. However both 5' and 3' UTR may also be used for the performing the methods of the invention.

EXAMPLES

Figure 4:
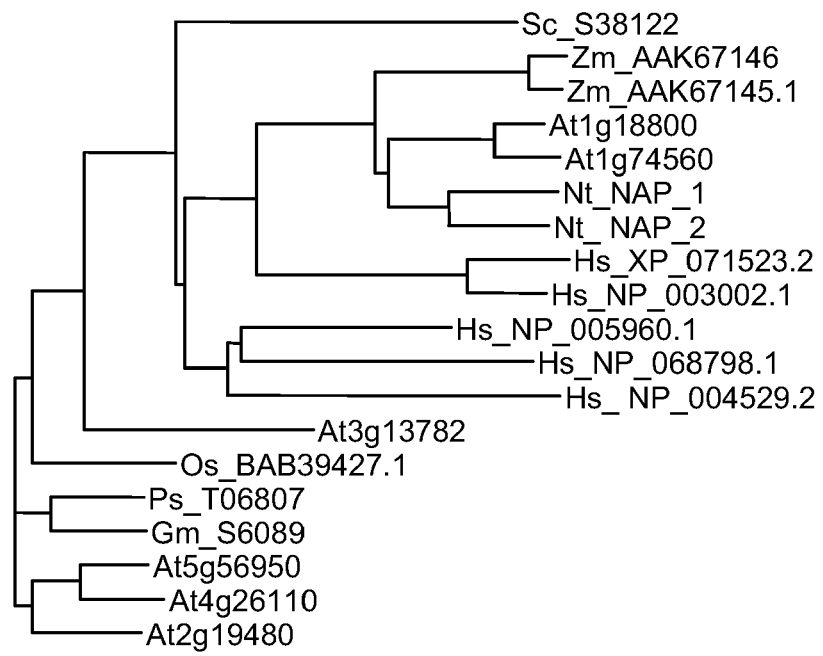
FIG. 4 is a phylogenetic tree representing the relationships among NAP and SET proteins from yeast, man and plants. References indicated in the tree are GenBank and MIPS (for *Arabidopsis thaliana*) accession numbers of the sequences. At: *Arabidopsis thaliana*, Gm: *Glycine max*, Nt: *Nicotiana tabacum* (sequences derived from WO 03/085115), Os: *Oryza sativa*, Ps: *Pisum sativum*, Zm: *Zea mays*, Hs: *Homo sapiens*, Sc: *Saccharomyces cerevisiae*.

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant ecular Biology Labfax (1993) by R. D. D. Croy, published by BIOS Scientific Publications Ltd (UK) and Blackwell Scientific Publications (UK).

Example 1

Identification of Sequences Related to SEQ ID NO: 1 and SEQ ID NO: 2

Sequences (full length cDNA, ESTs or genomic) related to SEQ ID NO: 1 and/or protein sequences related to SEQ ID NO: 2 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 1 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

Table A provides a list of nucleic acid and protein sequences related to the nucleic acid sequence as represented by SEQ ID NO: 1 and the protein sequence represented by SEQ ID NO: 2.

TABLE A

Nucleic acid sequences encoding NAP1-like polypeptides and NAP1-like polypeptides.

| Name/identifier | Source organism | Nucleic acid SEQ ID NO: | Polypeptide SEQ ID NO: |
|---|---|---|---|
| AtNAP1 | Arabidopsis thaliana | 1 | 2 |
| NtNAP1a | Nicotiana tabacum | 6 | 7 |
| NtNAP1b | Nicotiana tabacum | 8 | 9 |

TABLE A-continued

Nucleic acid sequences encoding NAP1-like polypeptides and NAP1-like polypeptides.

| Name/identifier | Source organism | Nucleic acid SEQ ID NO: | Polypeptide SEQ ID NO: |
|---|---|---|---|
| Ms10.1 | Medicago sativa | 10 | 11 |
| nfa104 | Zea mays | 12 | 13 |
| OsNAP1a | Oryza sativa | 14 | 15 |
| OsNAP1b | Oryza sativa | 16 | 17 |
| nfa103 | Zea mays | 18 | 19 |
| NAP1-like | Arabidopsis thaliana | 20 | 21 |
| LeNAP1 | Lycopersicon esculentum | 22 | 23 |
| NAP1-like | Arabidopsis thaliana | 24 | 25 |
| NAP1-like | Arabidopsis thaliana | 26 | 27 |
| NAP1-like | Arabidopsis thaliana | 28 | 29 |
| NAP1-like | Arabidopsis thaliana | 30 | 31 |
| NAP1Ps | Pisum sativum | 35 | 36 |
| SNAP-1 | Glycine max | 37 | 38 |

Example 2

Alignment of NAP1-Like Polypeptide Sequences

Alignment of polypeptide sequences was performed using the AlignX programme from the Vector NTI (Invitrogen) which is based on the popular Clustal algorithm of progressive alignment (Thompson et al. (1997) Nucleic Acids Res 25:4876-4882; Chema et al. (2003). Nucleic Acids Res 31:3497-3500). Default values are gap open penalty of 10, gap extension penalty of 0, 1 and the selected weight matrix is Blosum 62 (if polypeptides are aligned). Results in FIG. 3 show that NAP1-like polypeptides share regions of high sequence conservation.

A phylogenetic tree representing the relationships among NAP and SET proteins from yeast, man and plants is given in FIG. 4. The tree was established by the AlignX program of VNTI Suite 5.5 (Informax). The matrix used to generate the multiple alignment is Blosum62 and the alignment parameters used were: Gap Opening penalty, 10; Gap Extension penalty, 0.5; Gap separation penalty range, 8; % identity for alignment delay, 40. The tree was built using the Neighbor Joining method of Saitou and Nei.

Example 3

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B for the global similarity and identity over the full length of the polypeptide sequences (excluding the partial polypeptide sequences). Percentage identity is given above the diagonal and percentage similarity is given below the diagonal.

The percentage identity between the full length polypeptide sequences useful in performing the methods of the invention can be as low as 22% amino acid identity compared to SEQ ID NO: 2. Because the NAP domain covers the largest part of the protein sequence, the sequence identity is only slightly higher when the NAP domains are compared.

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 2 are presented in Table C.

TABLE B1

MatGAT results for global similarity and identity over the full length of the polypeptide sequences.

| | 1 | 2 | 3 | 4 | 5 | 6 | 7 | 8 | 9 | 10 | 11 | 12 | 13 | 14 | 15 | 16 |
|---|---|---|---|---|---|---|---|---|---|---|---|---|---|---|---|---|
| 1. SEQID2 | | 69.5 | 65.9 | 71.6 | 59.5 | 54.8 | 63.7 | 61.6 | 84.7 | 65.7 | 22.5 | 23.4 | 22.9 | 22.4 | 23.4 | 23.7 |
| 2. SEQID7 | 84.8 | | 83.5 | 69.7 | 64.8 | 59.7 | 64.4 | 63.3 | 72.2 | 80.9 | 25.7 | 23.9 | 24.3 | 21.7 | 26.8 | 26.7 |
| 3. SEQID9 | 81.9 | 92.7 | | 66.4 | 57.5 | 53.6 | 59.9 | 57.7 | 65.6 | 83.3 | 23.3 | 23.4 | 24.2 | 24.7 | 25.2 | 25.8 |
| 4. SEQID11 | 85.8 | 84.2 | 81.9 | | 60.5 | 56.9 | 60.4 | 59.3 | 68.8 | 67.0 | 21.4 | 21.8 | 21.9 | 25.1 | 22.9 | 23.4 |
| 5. SEQID13 | 79.1 | 79.5 | 75.0 | 76.2 | | 63.9 | 78.2 | 89.9 | 62.7 | 57.8 | 22.3 | 21.6 | 21.7 | 23.7 | 22.1 | 22.6 |
| 6. SEQID15 | 74.5 | 76.4 | 73.5 | 73.5 | 78.8 | | 65.2 | 61.8 | 56.3 | 52.3 | 23.6 | 23.2 | 23.2 | 22.0 | 24.3 | 24.8 |
| 7. SEQID17 | 79.7 | 79.3 | 75.0 | 75.4 | 88.0 | 80.7 | | 80.3 | 64.4 | 55.2 | 21.7 | 21.5 | 21.6 | 21.2 | 21.0 | 22.6 |
| 8. SEQID19 | 78.9 | 77.7 | 73.5 | 74.6 | 93.4 | 76.1 | 89.3 | | 63.7 | 57.1 | 21.0 | 22.4 | 20.9 | 22.3 | 21.0 | 21.8 |
| 9. SEQID21 | 92.2 | 84.8 | 81.9 | 84.2 | 80.2 | 76.1 | 80.5 | 78.1 | | 69.8 | 24.9 | 24.5 | 24.8 | 23.5 | 25.1 | 26.4 |
| 10. SEQID23 | 83.9 | 90.4 | 92.0 | 82.8 | 75.9 | 72.8 | 74.3 | 73.6 | 84.3 | | 26.0 | 25.0 | 27.4 | 26.5 | 26.8 | 26.2 |
| 11. SEQID25 | 40.3 | 41.9 | 41.4 | 41.9 | 39.5 | 41.7 | 38.2 | 38.2 | 41.1 | 43.3 | | 75.1 | 84.0 | 44.2 | 69.8 | 70.2 |
| 12. SEQID27 | 39.8 | 40.6 | 40.9 | 41.4 | 39.8 | 40.1 | 39.1 | 38.3 | 39.6 | 42.7 | 87.9 | | 76.3 | 45.9 | 71.5 | 70.0 |
| 13. SEQID29 | 40.4 | 41.4 | 41.7 | 43.0 | 38.8 | 40.1 | 37.4 | 38.8 | 40.4 | 42.8 | 92.8 | 88.7 | | 43.8 | 74.1 | 72.2 |
| 14. SEQID31 | 41.9 | 42.6 | 43.8 | 45.3 | 41.3 | 42.9 | 42.6 | 41.0 | 42.2 | 44.1 | 61.8 | 61.2 | 61.8 | | 47.2 | 46.4 |
| 15. SEQID36 | 41.8 | 42.3 | 42.1 | 41.8 | 39.6 | 39.1 | 37.7 | 38.0 | 42.6 | 43.2 | 85.8 | 85.2 | 86.1 | 62.8 | | 79.4 |
| 16. SEQID38 | 41.1 | 43.3 | 43.9 | 43.9 | 42.2 | 41.6 | 41.3 | 40.5 | 41.9 | 45.3 | 85.2 | 84.4 | 84.8 | 63.7 | 89.3 | |

TABLE B2

MatGAT results for similarity and identity over the NAP domain of the polypeptide sequences.

| | 1 | 2 | 3 | 4 | 5 | 6 | 7 | 8 | 9 | 10 | 11 | 12 | 13 | 14 | 15 | 16 |
|---|---|---|---|---|---|---|---|---|---|---|---|---|---|---|---|---|
| 1. SEQID2 | | 73.8 | 70.9 | 77.0 | 64.3 | 59.3 | 68.3 | 64.3 | 88.5 | 73.7 | 23.8 | 27.1 | 25.9 | 25.4 | 25.6 | 25.0 |
| 2. SEQID7 | 88.6 | | 85.9 | 76.2 | 70.1 | 67.2 | 70.1 | 69.7 | 77.7 | 84.8 | 29.0 | 28.7 | 28.7 | 26.7 | 31.3 | 29.9 |
| 3. SEQID9 | 84.9 | 93.7 | | 72.3 | 63.4 | 59.5 | 65.9 | 63.4 | 71.7 | 87.8 | 27.0 | 27.5 | 26.7 | 29.2 | 30.5 | 28.3 |
| 4. SEQID11 | 89.4 | 88.6 | 84.4 | | 63.6 | 62.1 | 65.2 | 63.6 | 74.5 | 73.7 | 24.1 | 23.8 | 25.0 | 24.9 | 26.0 | 25.3 |
| 5. SEQID13 | 83.4 | 82.1 | 78.5 | 80.8 | | 70.6 | 83.8 | 94.4 | 68.3 | 62.7 | 25.1 | 26.0 | 24.8 | 24.5 | 24.6 | 24.3 |
| 6. SEQID15 | 80.4 | 82.1 | 77.1 | 78.3 | 83.2 | | 72.6 | 68.5 | 62.3 | 58.8 | 27.4 | 27.5 | 27.1 | 24.2 | 27.0 | 26.2 |
| 7. SEQID17 | 83.9 | 84.1 | 80.0 | 81.3 | 92.3 | 87.3 | | 84.3 | 70.4 | 63.2 | 25.0 | 25.9 | 24.3 | 22.8 | 23.7 | 24.2 |
| 8. SEQID19 | 81.9 | 80.6 | 77.6 | 80.3 | 97.4 | 82.7 | 91.8 | | 67.8 | 62.7 | 25.1 | 26.0 | 24.8 | 24.1 | 24.2 | 24.7 |
| 9. SEQID21 | 94.0 | 89.1 | 86.3 | 88.4 | 83.4 | 82.4 | 86.4 | 81.9 | | 75.1 | 27.4 | 29.1 | 28.3 | 26.3 | 27.8 | 28.7 |
| 10. SEQID23 | 86.8 | 93.1 | 95.6 | 85.3 | 78.9 | 77.5 | 79.9 | 77.9 | 87.3 | | 27.8 | 29.6 | 29.6 | 30.8 | 31.3 | 29.5 |
| 11. SEQID25 | 45.7 | 49.4 | 48.6 | 46.2 | 45.7 | 45.7 | 46.2 | 44.9 | 46.2 | 49.0 | | 78.9 | 87.4 | 57.4 | 73.7 | 75.7 |
| 12. SEQID27 | 46.3 | 48.8 | 48.4 | 47.6 | 47.2 | 45.1 | 47.6 | 46.3 | 46.7 | 50.0 | 90.3 | | 80.9 | 59.6 | 75.6 | 78.0 |
| 13. SEQID29 | 45.9 | 48.8 | 47.6 | 46.7 | 45.5 | 45.1 | 45.1 | 45.1 | 45.9 | 49.6 | 93.9 | 91.1 | | 58.0 | 77.6 | 78.0 |
| 14. SEQID31 | 45.8 | 48.3 | 48.3 | 47.1 | 43.3 | 44.2 | 44.2 | 43.3 | 46.3 | 50.0 | 75.7 | 76.4 | 76.0 | | 61.8 | 60.3 |
| 15. SEQID36 | 48.3 | 50.4 | 49.2 | 47.1 | 44.6 | 44.2 | 44.6 | 44.2 | 47.5 | 50.8 | 84.6 | 86.6 | 86.2 | 75.8 | | 84.0 |
| 16. SEQID38 | 46.1 | 50.2 | 49.4 | 48.1 | 46.5 | 44.4 | 47.3 | 46.1 | 47.3 | 51.4 | 87.4 | 88.2 | 88.6 | 76.5 | 91.4 | |

TABLE C

InterPro scan results of the polypeptide sequence
as represented by SEQ ID NO: 2

| Database | Accession number | Accession name |
|---|---|---|
| PANTHER | PTHR11875 | NAP_family |
| PANTHER | PTHR11875:SF9 | PTHR11875:SF9 |
| PFAM | PF00956 | NAP |

Example 5

Topology Prediction of the Polypeptide Sequences Useful in Performing the Methods of the Invention (Subcellular Localization, Transmembrane . . . )

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 2 are presented Table D. The "plant" organism group has been selected, no cutoffs defined, and the predicted length of the transit peptide requested. The subcellular localization of the polypeptide sequence as represented by SEQ ID NO: 2 may be the cytoplasm or nucleus, no transit peptide is predicted.

TABLE D

TargetP 1.1 analysis of the polypeptide sequence as represented by SEQ ID NO: 2

| | |
|---|---|
| Length (AA) | 256 |
| Chloroplastic transit peptide | 0.108 |
| Mitochondrial transit peptide | 0.079 |
| Secretory pathway signal peptide | 0.134 |
| Other subcellular targeting | 0.908 |
| Predicted Location | / |
| Reliability class | 2 |
| Predicted transit peptide length | / |

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark Example 6

Characterisation of a *Medicago sativa* NAP1-Like Protein

Materials and Methods

Isolation of the Full-Length cDNA Clone of the Putative Alfalfa PP2A-Inhibitor

An isolated cDNA fragment coding for a part of an alfalfa (*Medicago sativa*) putative NAP1-like protein has been used to isolate the full-length clone from an alfalfa root-nodule λ-ZAP phage cDNA library (Savoure et al. Plant Mol. Biol. 27, 1059-1070; 1995) using standard screening procedures as described by the manufacturer (Stratagene). 400 000 plaques were screened, 20 clones were retained, of which 18 were positive in the second hybridization screen. 8 of these clones were selected for further work and converted into phagemids from individual phages. Four clones were sequenced and two of them proved to be the full-length cDNA clones of the putative NAP1-like protein. One of the clones (Ms10.1) was used for further work (SEQ ID NO: 10, encoding the protein of SEQ ID NO: 11).

Production and Purification of the Medicago NAP1-Like Protein

Figure 5:
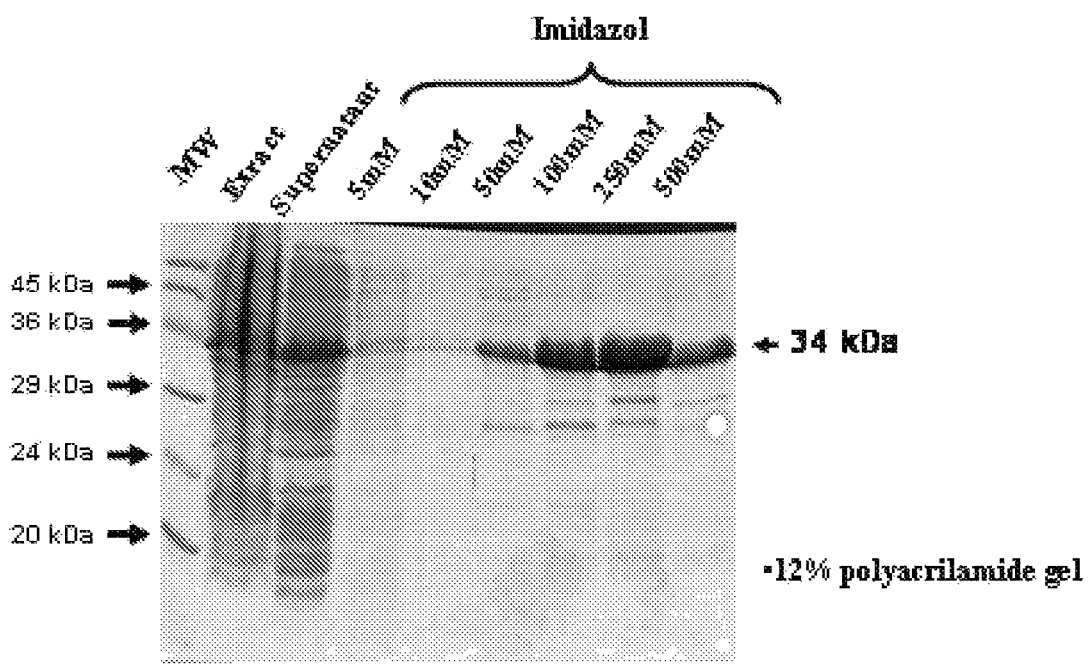
FIG. 5 The *Medicago* NAP1-like protein was expressed in *E. coli* and purified from crude cell extract by affinity chromatography via the 6xHIS-tag. Elution of the 34 kD protein at different imidazol concentrations from the nickel-agarose resin is visualised by Western blotting using anti-6xHIS antibody (Sigma, St Louis, USA).

The cDNA sequence coding for the *Medicago sativa* NAP1-like protein was inserted into the NcoI/XhoI site of the pENTRY4 GATEWAY® vector (Invitrogen) and subsequently introduced into the pDEST17 bacterial expression vector. The pDEST17 vector allowed the expression of the NAP1-like protein in BL21 *E. coli* cells as a 6×HIS-tagged protein. The 34 kDa NAP1-like protein was purified by affinity chromatography using a nickel agarose resin (Sigma) (FIG. 5).

Phosphatase Activity Measurements

Potential phosphatase-inhibiting activity of the *Medicago sativa* NAP1-like protein was tested in vitro on Protein Phosphatase 2A (PP2A) catalytic subunits purified from rabbit skeletal muscle using 32P-isotope-labelled glycogen phosphorylase and histone H2A proteins as substrates according to Ulloa et al. (1993).

Intracellular Localization of the MsNAP1-Like and AtNAP1-Like Proteins

Polyclonal anti-MsNAP1-like antibodies were raised in rabbits against the purified 6×HIS-tagged protein using a standard immunization protocol.

Protoplasts were isolated from suspension cultured alfalfa (*Medicago sativa*) cells and fixed by 6% formaldehyde. The cells were than attached to poly-L-lysine coated glass slides and exposed to the anti-MsNAP1-like antiserum (200× diluted in PBS), washed and exposed to FITC-conjugated goat anti-rabbit secondary antibody (SIGMA, 100× dilution). Nuclei were stained with DAPI (0.02 mg/ml) in parallel and photographed with a Nikon TE300 fluorescent microscope and a SPOT II colour CCD camera.

The coding region of the *Arabidopsis thaliana* orthologue of the *Medicago sativa* NAP1-like protein (SEQ ID NO: 1), was inserted in frame with the green fluorescent protein (GFP) into the GATEWAY®-compatible plant expression vector (pK7WGF2). Protoplasts were isolated and transfected with the purified plasmid DNA using standard procedures. Transient expression was recorded one or two days after transfection by fluorescence microscopy.

Results

*Arabidopsis* and *Medicago* NAP1-Like Proteins are Localised in the Nucleus

Using the anti-MsNAP1-like antibodies, indirect immunofluorescence revealed that the antibodies recognised a protein that was localized to the nuclei of suspension cultured alfalfa cells. This localisation was verified by the nuclear stain, DAPI. Faint fluorescence was associated with the chromosomes in metaphase cells (FIG. 6.A, insert).

The GFP-tagged *Arabidopsis* NAP1-like protein was also exclusively localised to the nuclei of suspension cultured *Arabidopsis* cells (FIG. 6.B).

Figure 7:
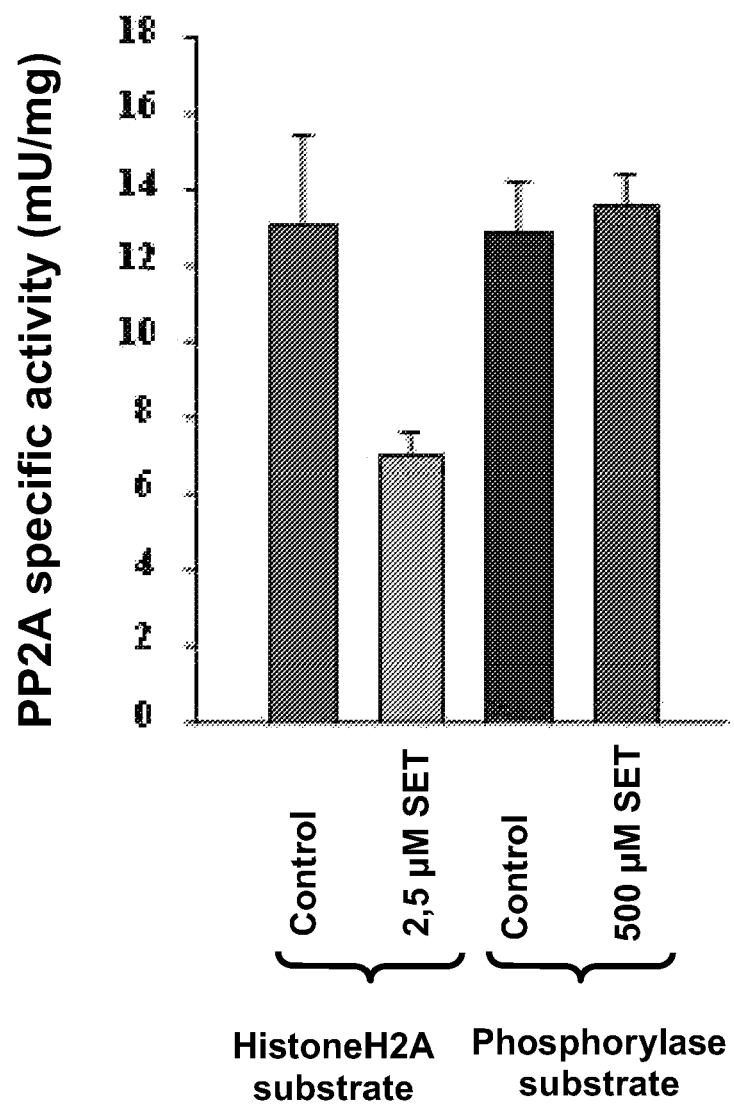
FIG. 7 The purified *Medicago* NAP1-like protein inhibits in vitro phospho-histone $H_2B$ dephosphorylation activity of PP2A (purified from rabbit skeletal muscle), but has no influence on the dephosphorylation of the glycogen phosphorylase by the same enzyme.
Figure 9:
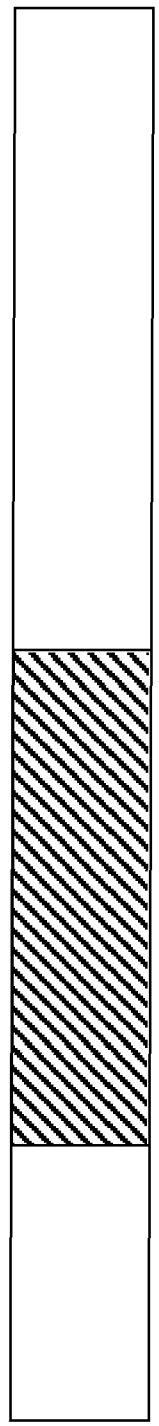
FIG. 9 shows the domain structure of SEQ ID No. 41. The shaded rectangle indicates the position of the Lsm domain.

The Alfalfa NAP1-Like Protein Inhibits In Vitro PP2A Phosphatase Activity on a Phospho-Histone Substrate Purified alfalfa NAP1-like protein was added at various concentrations to reaction mixtures containing the catalytic subunits of rabbit skeletal muscle PP2A and phosphorylated histone H2A, or glycogen phosphorylase as substrate. It was observed that the NAP1-like protein had no influence on the dephosphorylation of the glycogen phosphorylase even at 500 mM concentration, but already 2.5 mM concentration of the NAP1-like protein efficiently inhibited PP2A activity on the phospho-histonH2A substrate (50% decrease in activity) (FIG. 7).

Conclusion

The *Medicago sativa* and *Arabidopsis thaliana* NAP1-like proteins show both structurally and functionally resemblance. Plant NAP1-like proteins inhibit in vitro phosphatase (PP2A) activity on histone substrates, indicating a possible in vivo role on chromatin organisation and gene transcription.

Example 7

Expression Vector Construction Using the Nucleic Acid Sequence as Represented by SEQ ID NO: 1

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis* NAP1-like nucleic acid was amplified by PCR using as template an *Arabidopsis thaliana* seedling cDNA library (Invitrogen, Paisley, UK). After reverse transcription of RNA extracted from seedlings, the cDNAs were cloned into pCMV Sport 6.0. Average insert size of the bank was 1.5 kb, and original number of clones was of $1.59 \times 10^7$ cfu. Original titer was determined to be $9.6 \times 10^5$ cfu/ml, after first amplification of $6 \times 10^{11}$ cfu/ml. After plasmid extraction, 200 ng of template was used in a 50 µl PCR mix. Primers prm1505 (SEQ ID NO: 4) and prm1506 (SEQ ID NO: 5), which include the AttB sites for Gateway recombination, were used for PCR amplification. PCR was performed using Hifi Taq DNA polymerase in standard conditions. A PCR fragment of 771 by was amplified and purified also using standard methods. The first step of the Gateway procedure, the BP reaction, was then performed, during which the PCR fragment recombines in vivo with the pDONR201 plasmid to produce, according to the Gateway terminology, an "entry clone", pNAP1-like. Plasmid pDONR201 was purchased from Invitrogen, as part of the Gateway® technology.

The entry clone pNAP1-like was subsequently used in an LR reaction with a destination vector used for *Oryza sativa* transformation, comprising as functional elements within the T-DNA borders: a plant selectable marker; a visual marker expression cassette; and a Gateway cassette intended for LR in vivo recombination with the sequence of interest already cloned in the entry clone. A GOS2 promoter for constitutive expression is located upstream of this Gateway cassette. After the LR recombination step, the resulting expression vector pGOS2::NAP1-like (FIG. 2) was transformed into the *Agrobacterium* strain LBA4404 and subsequently to *Oryza sativa* plants using methods well known in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L $K_2SO_4$, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 9

Phenotypic Evaluation Procedure 9.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. The rice plants were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Greenhouse conditions were of shorts days (12 hours light), 28° C. in the light and 22° C. in the dark, and a relative humidity of 70%. Seed-related parameters were then measured.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

9.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

9.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass, areamax) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 10

Results of the Phenotypic Evaluation of the Transgenic Plants

An increase in biomass and seed yield, as shown in Table F, was observed for the transgenic plants, compared to the corresponding nullizygotes (controls), in each case, the p-value was lower than 0.05.

| Parameter | Increase (in %) |
|---|---|
| Areamax (biomass) | 17.0 |
| Total weight of seeds | 35.9 |
| Number of filled seeds | 34.7 |
| Seed fill rate | 11.6 |
| Harvest Index | 17.1 |

Example 11

Identification of Sequences Related to SEQ ID NO: 40 and SEQ ID NO: 41

Sequences (full length cDNA, ESTs or genomic) related to SEQ ID NO: 40 and/or protein sequences related to SEQ ID NO: 41 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. The polypeptide encoded by SEQ ID NO: 40 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

In addition to the publicly available nucleic acid sequences available at NCBI, proprietary sequence databases are also searched following the same procedure as described herein above.

Table G provides a list of nucleic acid and protein sequences related to the nucleic acid sequence as represented by SEQ ID NO: 40 and the protein sequence represented by SEQ ID NO: 41.

Lsm proteins are classified in eight groups or classes. The column headed "Lsm class" in Table G indicates the class to which the Lsm protein or the corresponding nucleic acid encoding such protein belongs.

Homologues, orthologous and paralogous sequences to SEQ ID No. 41 are indicated in the column headed "Evolutionary relationship to SEQ ID No. 41".

TABLE G

Nucleic acid sequences related to the nucleic acid sequence (SEQ ID NO: 40) useful in the methods of the present invention, and the corresponding deduced polypeptides.

| Name | Accession Nr* | Source organism | Nucleic acid SEQ ID NO: | Polypeptide SEQ ID NO: | Lsm class | Evolutionary relationship to SEQ ID No. 41 | Status |
|---|---|---|---|---|---|---|---|
| AtLSM1a | AT1G19120 | Arabidopsis thaliana | 40 | 41 | Lsm1 | NA | Full length |
| AtLSM1b | AT3G14080 | Arabidopsis thaliana | 42 | 43 | Lsm1 | Paralogue | Full length |
| AtLMS2 | At1g03330 | Arabidopsis thaliana | 44 | 45 | Lsm2 | Homologue | Full length |
| AtLSM3a | AT1G21190 | Arabidopsis thaliana | 46 | 47 | Lsm3 | Homologue | Full length |
| AtLSM3b | At1g76860 | Arabidopsis thaliana | 48 | 49 | Lsm3 | Homologue | Full length |
| AtLMS4 | AT5G27720 | Arabidopsis thaliana | 50 | 51 | Lsm4 | Homologue | Full length |
| AtLMS5 | AT5G48870 | Arabidopsis thaliana | 52 | 53 | Lsm5 | Homologue | Full length |
| AtLMS6a | AT3G59810 | Arabidopsis thaliana | 54 | 55 | Lsm6 | Homologue | Full length |
| AtLMS6b | AT2G43810 | Arabidopsis thaliana | 56 | 57 | Lsm6 | Homologue | Full length |
| AtLMS7 | AT2G03870 | Arabidopsis thaliana | 58 | 59 | Lsm7 | Homologue | Full length |
| AtLMS8 | AT1G65700 | Arabidopsis thaliana | 60 | 61 | Lsm8 | Homologue | Full length |
| MsABE78228 | ABE78228 | Medicago truncatula | 62 | 63 | Lsm1 | Orhtologue | Full length |
| PpLSM1 | scaffold_158 | Populus trichocarpa | 64 | 65 | Lsm1 | Orthologue | Full length |
| OsLSM1 | Os04g0445800 | Oryza sativa (japonica cultivar-group) | 66 | 67 | Lsm1 | Orthologue | Full length |
| OsLSM3 | Os01g0866700 | Oryza sativa (japonica cultivar-group) | 68 | 69 | Lsm3 | Homologue | Full length |
| OsLMS4 | Os01g0256900 | Oryza sativa (japonica cultivar-group) | 70 | 71 | Lsm4 | Homologue | Full length |
| OsLSM5 | Os05g0389300 | Oryza sativa (japonica cultivar-group) | 72 | 73 | Lsm5 | Homologue | Full length |

TABLE G-continued

Nucleic acid sequences related to the nucleic acid sequence (SEQ ID NO: 40) useful in the methods of the present invention, and the corresponding deduced polypeptides.

| Name | Accession Nr* | Source organism | Nucleic acid SEQ ID NO: | Polypeptide SEQ ID NO: | Lsm class | Evolutionary relationship to SEQ ID No. 41 | Status |
|---|---|---|---|---|---|---|---|
| OsLSM6 | Os04g0388900 | Oryza sativa (japonica cultivar-group) | 74 | 75 | Lsm6 | Homologue | Full length |
| OsLSM7 | Os08g0177700 | Oryza sativa (japonica cultivar-group) | 76 | 77 | Lsm7 | Homologue | Full length |
| OsLSM8 | Os05g0594900 | Oryza sativa (japonica cultivar-group) | 78 | 79 | Lsm8 | Homologue | Full length |
| Os_LSM | CAH67241 | Oryza sativa (indica cultivar-group) | 80 | 81 | Lsm1 | Orthologue | Full length |
| LuLSM8 LU04FL@62341874 | NA | Linum usitatissimum | 82 | 83 | Lsm8 | Homologue | Full length |
| BnLSM1a BNM01@BN04MC02973 | NA | Brassica napus | 84 | 85 | Lsm1 | Orthologue | Full length |
| BnLSM1b BN0204@contig12290 | NA | Brassica napus | 86 | 87 | Lsm1 | Orthologue | Full length |
| BnLSM1c BN0204@contig30411 | NA | Brassica napus | 88 | 89 | Lsm1 | Orthologue | Full length |
| BnLSM4a BN04FL@41982578 | NA | Brassica napus | 90 | 91 | Lsm4 | Homologue | Full length |
| BnLSM4b BN04FL@42120216 | NA | Brassica napus | 92 | 93 | | Homologue | Full length |
| BnLSM4c BN04FL@42952553 | NA | Brassica napus | 94 | 95 | Lsm4 | Homologue | Full length |
| GmLSM4a GM04FL@GM06LC725 | NA | Glycine max | 96 | 97 | Lsm4 | Homologue | Full length |
| GmLSM4b GM04FL@GM06LC5469 | NA | Glycine max | 98 | 99 | Lsm4 | Homologue | Full length |
| GmLSM4c GM04FL@GM06MC03669 | NA | Glycine max | 100 | 101 | Lsm4 | Homologue | Full length |
| Gm_LSM5 GM04FL@GM02LC15807 | NA | Glycine max | 102 | 103 | Lsm5 | Homologue | Full length |
| HvLSM1 HV04FL@63122459 | NA | Hordeum vulgare | 104 | 105 | Lsm1 | Orthologue | Full length |
| HvLSM4 HV04FL@62658793 | NA | Hordeum vulgare | 106 | 107 | Lsm4 | Homologue | Full length |
| TaLSM1 TA0704@contig16414 | NA | Triticum aestivum | 108 | 109 | Lsm1 | Orthologue | Full length |
| TaLSM4a TA04FL@TA02LC45139 | NA | Triticum aestivum | 110 | 111 | Lsm4 | Homologue | Full length |
| TaLSM4b TA04FL@TA02LC24263 | NA | Triticum aestivum | 112 | 113 | Lsm4 | Homologue | Full length |
| ZmLSM1 ZM0404@contig12257 | NA | Zea mays | 114 | 115 | Lsm1 | Orthologue | Full length |
| ZmLSM4a ZM04FL@ZM06LC6366 | NA | Zea mays | 116 | 117 | Lsm4 | Homologue | Full length |

*Accession number refers to genebank database, the Populus sequence database at DOE Joint Genome Institute.
NA: It does not apply.

Example 12

Alignment and Phylogenetic Tree of Relevant Polypeptide Sequences

AlignX from Vector NTI (Invitrogen), based on the popular Clustal algorithm of progressive alignment (Thompson et al. (1997) Nucleic Acids Res 25: 4876-4882; Chema et al. (2003). Nucleic Acids Res 31: 3497-3500) was used for the alignment of Lsm protein sequences. A phylogenetic tree was constructed using a neighbour-joining clustering algorithm. Default values were used for the gap open penalty of 10, for the gap extension penalty of 0.1 and the selected weight matrix is Blosum 62.

Figure 10A:
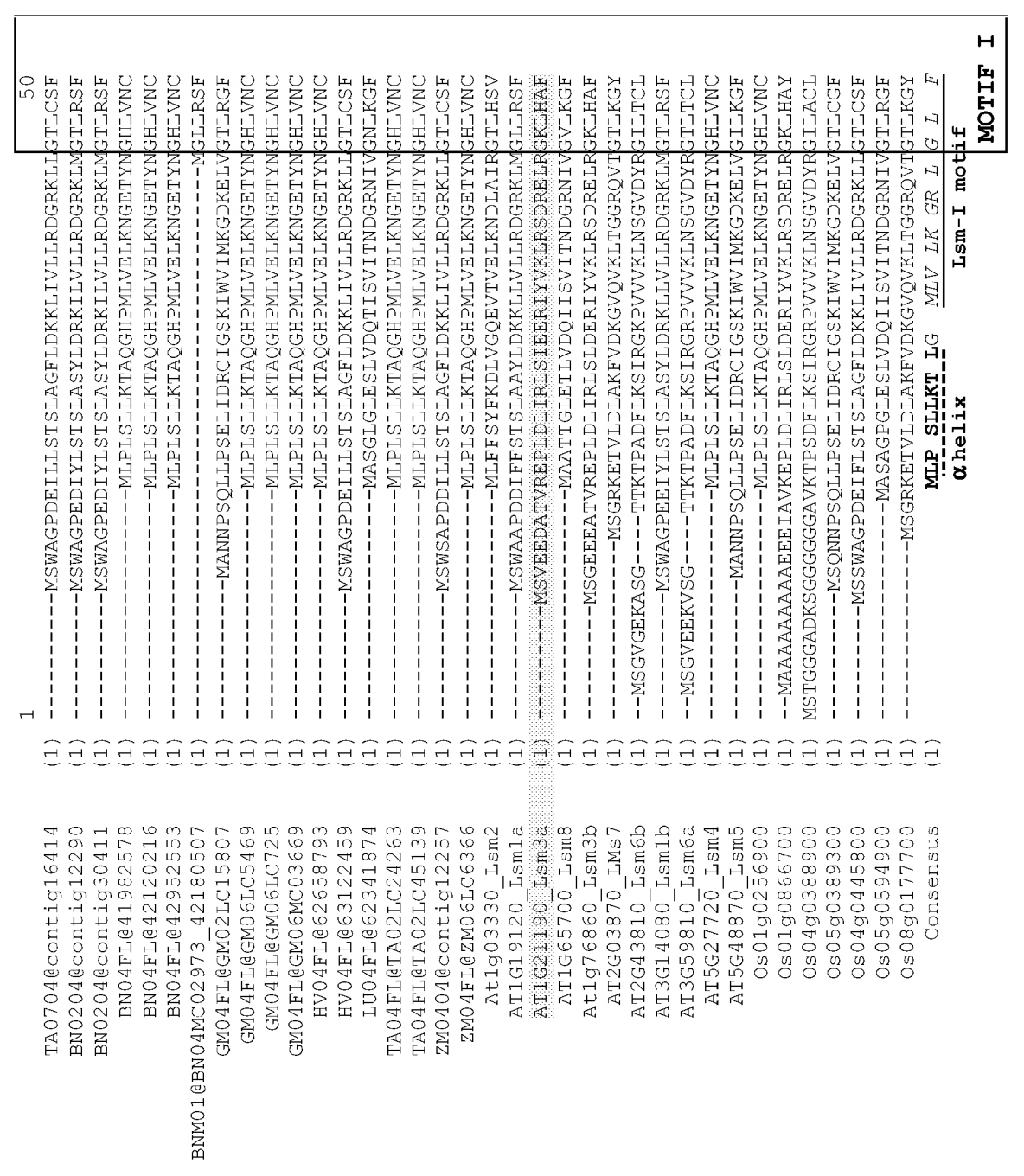
Figure 10:
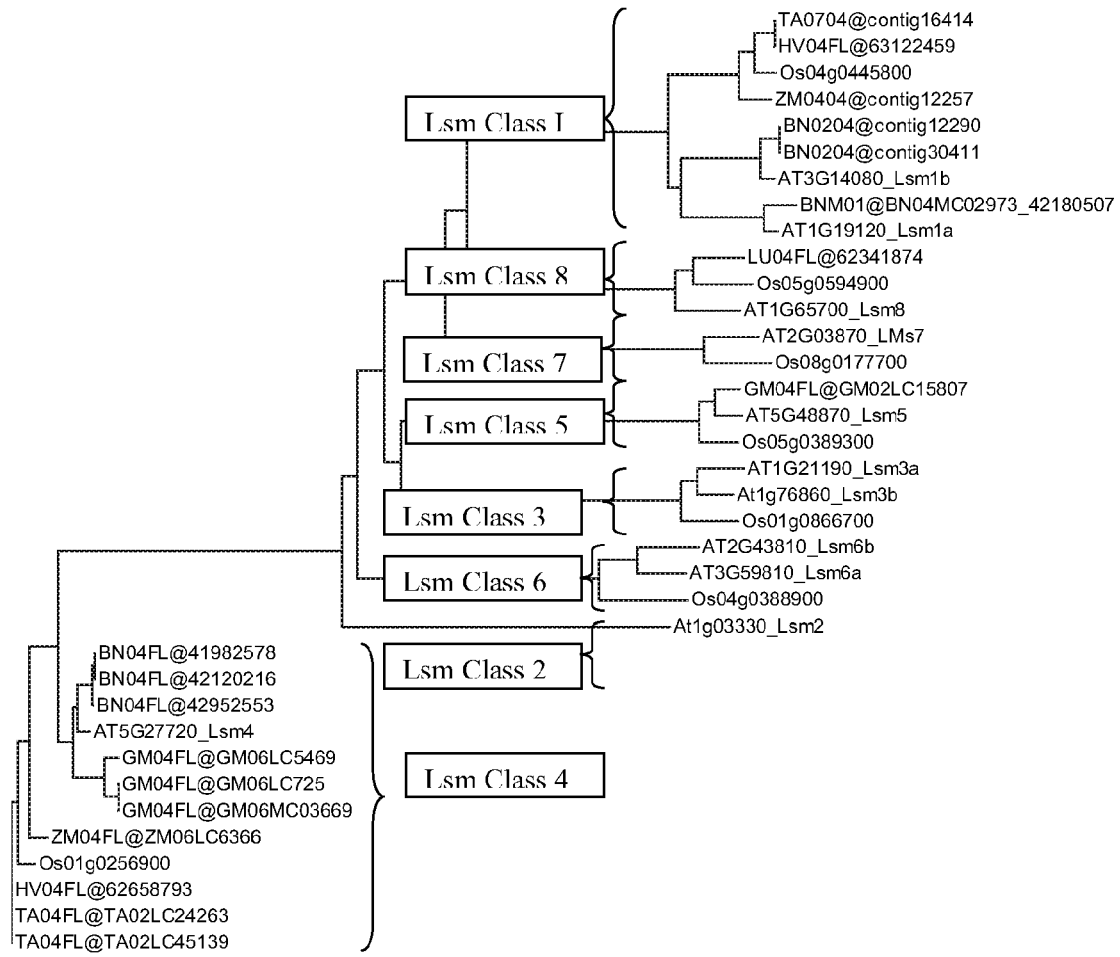
FIG. 10 shows an alignment (FIG. 10A) and the corresponding phylogenetic tree of Lsm proteins (FIG. 10B). Position of the conserved domains is indicated: a dashed line indicates the position of the alpha-helix; the Lms motif I and II are underlined with a single and a doubled line respectively; the motif I and motif II as represented by SEQ ID No. 159 and SEQ ID No. 160 are boxed. Sequences shown are: TA0704@contig16414 (SEQ ID NO: 109); BNO204@contig12290 (SEQ ID NO: 87); BNO204@contig30411 (SEQ ID NO: 89); BNO4FL@41982578 (SEQ ID NO: 91); BNO4FL@42120216 (SEQ ID NO: 93); BNO4FL@42952553 (SEQ ID NO: 95); BNMO1@BN04MC02973_42180507 (SEQ ID NO: 85); GM04FL@GM02LC15807 (SEQ ID NO: 103); GM04FL@GM06LC5469 (SEQ ID NO: 99); GM04FL@GM06LC725 (SEQ ID NO: 97); GM04FL@GM06MC03669 (SEQ ID NO: 101); HV04FL@62658793 (SEQ ID NO: 107); HV04FL@63122459 (SEQ ID NO: 105); LU04FL@62341874 (SEQ ID NO: 83); TA04FL@TA02LC24263 (SEQ ID NO: 113); TA04FL@TA02LC45139 (SEQ ID NO: 111); ZM0404@contig12257 (SEQ ID NO: 115); ZM04FL@ZM06LC6366 (SEQ ID NO: 117); At1g03330_Lsm2 (SEQ ID NO: 45); AT1G19120_Lsm1a (SEQ ID NO: 41); AT1G21190_Lsm3a (SEQ ID NO; 47); AT1G65700_Lsm8 (SEQ ID NO: 61); At1g76860_Lsm3b (SEQ ID NO: 49); AT2G03870_LMs7 (SEQ ID NO: 59); AT2G43810_Lsm6b (SEQ ID NO: 57); AT3G14080_Lsm1b (SEQ ID NO: 43); AT3G59810_Lsm6a (SEQ ID NO: 55); AT5G27720_Lsm4 (SEQ ID NO: 51); AT5G48870_Lsm5 (SEQ ID NO: 53); Os01g0256900 (SEQ ID NO: 71); Os01g0866700 (SEQ ID NO: 69); Os04g0388900 (SEQ ID NO: 75); Os05g0389300 (SEQ ID NO: 73); Os04g0445800 (SEQ ID NO: 67); Os05g0594900 (SEQ ID NO: 79); Os08g0177700 (SEQ ID NO: 77).

The result of the multiple sequence alignment performed with AlignX from the Vector NTI (Invitrogen) using default parameters is shown in FIG. 10A. A multiple sequence alignment and the corresponding the phylogenetic tree (FIG. 10B) of Lsm proteins was performed using the AlignX from the Vector NTI (Invitrogen) set to default parameters. Lsm polypeptides fall into clusters that include at least one Lsm protein of the group defined by the representative Lsm proteins from Arabidopsis thaliana as represented by SEQ ID Nos 41, 43, 45, 47, 49, 51, 53, 55, 57, 59, and 61 rather than clustering apart from the aforementioned representative sequences. Lsm1 proteins cluster around AtLsm1 and AtLsm2.

Lsm proteins in different classification groups cluster in distinct clades. Clades for Lsm classes 1 to 8 are shown.

The multiple alignment show that the highest sequence homology among Lsm polypeptide reside in the N-terminus of the protein. Conserved residues are indicated in the consensus sequence. The position of the conserved motif I and motif II are indicated. Also the characteristic motifs helix, Lsm-I motif and Lsm-II motif for the Lsm the family of proteins is shown.

Example 13

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B for the global similarity and identity over the full length of the polypeptide sequences (excluding the partial polypeptide sequences). Percentage identity is given above the diagonal and percentage similarity is given below the diagonal.

The percentage identity between the full length *Arabidopsis thalianan* Lsm proteins starts at about 17% amino acid identity compared to SEQ ID NO: 41. The closest paralogous sequence to SEQ ID NO: 41 is 79.7% identical to SEQ ID NO: 41 (Table H1).

The percentage identity between Lsm domains in the *Arabidopsis thalianan* Lsm proteins start at about 19% amino acid identity compared to SEQ ID NO: 41. The identity between Lsm domains of SEQ ID NO: 41 and that of its closest paralogue, AtLsm1b, is 84.3% (Table H2).

The percentage identity between the sequences of orthologous Lsm protein shown in Table H3 starts at about 55%. The closest orthologous protein to SEQ ID No: 41 in Table H3 is 84.3% identical to SEQ ID No: 41.

TABLE H1

MatGAT results for global similarity and identity over the *Arabidopsis thalianan* Lsm polypeptide sequences.

|  | | 1 | 2 | 3 | 4 | 5 | 6 | 7 | 8 | 9 | 10 | 11 |
|---|---|---|---|---|---|---|---|---|---|---|---|---|
| 1. | AtLsm1a |  | 84.3 | 26.2 | 20.2 | 21.4 | 24.1 | 22.9 | 25.3 | 25.3 | 34.1 | 39.3 |
| 2. | AtLsm1b | 92.8 |  | 23.8 | 25.9 | 25.6 | 22.9 | 24.1 | 30.3 | 24.1 | 36.4 | 38.1 |
| 3. | AtLsm2 | 42.2 | 43.4 |  | 19.1 | 20.7 | 31.1 | 20.7 | 25.6 | 24.4 | 21.4 | 23.7 |
| 4. | AtLsm3a | 39.3 | 39.3 | 42.9 |  | 90.5 | 22.4 | 29.8 | 24.1 | 25.3 | 23.6 | 22.4 |
| 5. | AtLsm3b | 39.3 | 39.3 | 41.7 | 96.4 |  | 22.4 | 29.8 | 23 | 23 | 23.6 | 23.5 |
| 6. | AtLsm4 | 36.1 | 38.6 | 48.6 | 39.3 | 39.3 |  | 23.2 | 25.9 | 24.7 | 22.4 | 25 |
| 7. | AtLsm5 | 48.2 | 47 | 39 | 46.4 | 46.4 | 40.2 |  | 19.5 | 19.5 | 20.7 | 28.9 |
| 8. | AtLsm6a | 41.7 | 44 | 42.9 | 46.4 | 46.4 | 45.2 | 39.3 |  | 90.5 | 28.3 | 23.9 |
| 9. | AtLsm6b | 40.5 | 40.5 | 44 | 46.4 | 45.2 | 42.9 | 39.3 | 92.9 |  | 30.4 | 22.7 |
| 10. | AtLMs7 | 50 | 53.6 | 32.1 | 47.6 | 48.8 | 34.5 | 47.6 | 46.4 | 44 |  | 32.1 |
| 11. | AtLsm8 | 61.4 | 59 | 38.2 | 36.9 | 36.9 | 40.8 | 47.6 | 45.2 | 44 | 46.4 |  |

TABLE H2

MatGAT results for global similarity and identity over the Lsm domain as present in the *Arabidopsis thalianan* Lsm polypeptide sequences.

|  | | 1 | 2 | 3 | 4 | 5 | 6 | 7 | 8 | 9 | 10 | 11 |
|---|---|---|---|---|---|---|---|---|---|---|---|---|
| 1. | At1g03330 Lsm2_domain |  | 26.2 | 19.1 | 23.7 | 20.7 | 21.4 | 24.4 | 23.8 | 25.6 | 31.1 | 20.7 |
| 2. | AT1G19120 Lsm1a_domain | 42.2 |  | 20.2 | 39.3 | 21.4 | 34.1 | 25.3 | 84.3 | 25.3 | 24.1 | 22.9 |
| 3. | AT1G21190 Lsm3a_domain | 42.9 | 39.3 |  | 22.4 | 90.5 | 23.6 | 25.3 | 25.9 | 24.1 | 22.4 | 29.8 |
| 4. | AT1G65700 Lsm8_domain | 38.2 | 61.4 | 36.9 |  | 23.5 | 31 | 22.7 | 38.1 | 23.9 | 25 | 28.9 |
| 5. | At1g76860 Lsm3b_domain | 41.7 | 39.3 | 96.4 | 36.9 |  | 23.6 | 23 | 25.6 | 23 | 22.4 | 29.8 |
| 6. | AT2G03870 LMs7_domain | 32.1 | 50 | 47.6 | 47.6 | 48.8 |  | 30.4 | 36.4 | 28.3 | 22.4 | 19.5 |
| 7. | AT2G43810 Lsm6b_domain | 44 | 40.5 | 46.4 | 44 | 45.2 | 44 |  | 24.1 | 90.5 | 24.7 | 19.5 |
| 8. | AT3G14080 Lsm1b_domain | 43.4 | 92.8 | 39.3 | 59 | 39.3 | 53.6 | 40.5 |  | 30.3 | 22.9 | 24.1 |
| 9. | AT3G59810 Lsm6a_domain | 42.9 | 41.7 | 46.4 | 45.2 | 46.4 | 46.4 | 92.9 | 44 |  | 25.9 | 19.5 |

TABLE H2-continued

MatGAT results for global similarity and identity over the Lsm domain as present in the *Arabidopsis thalianan* Lsm polypeptide sequences.

|  | 1 | 2 | 3 | 4 | 5 | 6 | 7 | 8 | 9 | 10 | 11 |
|---|---|---|---|---|---|---|---|---|---|---|---|
| 10. AT5G27720 Lsm4_domain | 48.6 | 36.1 | 39.3 | 40.8 | 39.3 | 34.5 | 42.9 | 38.6 | 45.2 |  | 23.2 |
| 11. AT5G48870 Lsm5_domain | 39 | 48.2 | 46.4 | 47.6 | 46.4 | 47.6 | 39.3 | 47 | 39.3 | 40.2 |  |

TABLE H3

MatGAT results for global similarity and identity between Lsm proteins belonging to the Lsm 1 class.

|  | 1 | 3 | 4 | 5 | 6 | 7 | 8 | 9 | 10 | 11 | 12 |
|---|---|---|---|---|---|---|---|---|---|---|---|
| 1. AtLSM1a |  | 79.7 | 84.4 | 76 | 72.1 | 70.3 | 77.3 | 77.3 | 76.6 | 76.6 | 76.6 |
| 3. MsABE78228 Lsm1 | 88.3 |  | 85.9 | 84.5 | 80.1 | 57 | 77.3 | 77.3 | 85.2 | 85.2 | 84.4 |
| 4. PpLSM1 | 90.6 | 93.8 |  | 80.6 | 76.5 | 60.9 | 85.9 | 85.9 | 81.3 | 81.3 | 79.7 |
| 5. OsLSM1 | 86.8 | 92.2 | 91.5 |  | 94.9 | 55 | 75.2 | 75.2 | 95.3 | 95.3 | 92.2 |
| 6. OsLSM | 82.4 | 87.5 | 86.8 | 94.9 |  | 52.2 | 71.3 | 71.3 | 90.4 | 90.4 | 87.5 |
| 7. BnLSM1a | 71.9 | 64.1 | 66.4 | 62.8 | 59.6 |  | 56.3 | 56.3 | 55.5 | 55.5 | 53.9 |
| 8. BnLSM1b | 88.3 | 91.4 | 93.8 | 90.7 | 86 | 63.3 |  | 100 | 75.8 | 75.8 | 75 |
| 9. BnLSM1c | 88.3 | 91.4 | 93.8 | 90.7 | 86 | 63.3 | 100 |  | 75.8 | 75.8 | 75 |
| 10. HvLSM1 | 85.9 | 93 | 90.6 | 97.7 | 92.6 | 62.5 | 89.8 | 89.8 |  | 100 | 92.2 |
| 11. TaLSM1 | 85.9 | 93 | 90.6 | 97.7 | 92.6 | 62.5 | 89.8 | 89.8 | 100 |  | 92.2 |
| 12. ZmLSM1 | 85.9 | 92.2 | 88.3 | 94.6 | 89.7 | 60.9 | 89.1 | 89.1 | 95.3 | 95.3 |  |

Example 14

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 2 are presented in Table 11.

TABLE I1

InterPro scan results of the polypeptide sequence as represented by SEQ ID NO: 2

| Database | Accession number | Accession name |
|---|---|---|
| Interpro | IPR006649 | LSM_core |
| Interpro | IPR010920 | LSM_related_core. |
| Interpro | IPR001163 | LSM_snRNP_core. |
| Pfam | PF01423 | LSM |
| ProDom | PD020287 | snRNP |
| SMART | SM00651 | Sm.1 |

TABLE I2

SEQ ID No. corresponding to the sequence of the Lsm domain present in the Lsm proteins listed in Table G.

| Name | SEQ ID No. | Name of the reference Lsm protein | SEQ ID NO. of the reference Lsm protein |
|---|---|---|---|
| AtLSM1a_domain | 120 | AtLSM1a | 41 |
| AtLSM1b_domain | 121 | AtLSM1b | 43 |
| AtLMS2_domain | 122 | AtLMS2 | 45 |
| AtLSM3a_domain | 123 | AtLSM3a | 47 |
| AtLSM3b_domain | 124 | AtLSM3b | 49 |
| AtLMS4_domain | 125 | AtLMS4 | 51 |
| AtLMS5_domain | 126 | AtLMS5 | 53 |
| AtLMS6a_domain | 127 | AtLMS6a | 55 |
| AtLMS6b_domain | 128 | AtLMS6b | 57 |
| AtLMS7_domain | 129 | AtLMS7 | 59 |
| AtLMS8_domain | 130 | AtLMS8 | 61 |
| MsABE78228_domain | 131 | MsABE78228 | 63 |
| PpLSM1_domain | 132 | PpLSM1 | 65 |
| OsLSM1_domain | 133 | OsLSM1 | 67 |
| OsLSM3_domain | 134 | OsLSM3 | 69 |
| OsLMS4_domain | 135 | OsLMS4 | 71 |
| OsLSM5_domain | 136 | OsLSM5 | 73 |
| OsLSM6_domain | 137 | OsLSM6 | 75 |
| OsLSM7_domain | 138 | OsLSM7 | 77 |
| OsLSM8_domain | 139 | OsLSM8 | 79 |
| Os_LSM_domain | 140 | Os_LSM | 81 |
| LuLSM8_domain | 141 | LuLSM8 | 83 |
| BnLSM1a_domain | 142 | BnLSM1a | 85 |
| BnLSM1b_domain | 143 | BnLSM1b | 87 |
| BnLSM1c_domain | 144 | BnLSM1c | 89 |
| BnLSM4a_domain | 145 | BnLSM4a | 91 |
| BnLSM4b_domain | 146 | BnLSM4b | 93 |
| BnLSM4c_domain | 147 | BnLSM4c | 95 |
| GmLSM4a_domain | 148 | GmLSM4a | 97 |
| GmLSM4b_domain | 149 | GmLSM4b | 99 |
| GmLSM4c_domain | 150 | GmLSM4c | 101 |
| Gm_LSM5_domain | 151 | Gm_LSM5 | 103 |
| HvLSM1_domain | 152 | HvLSM1 | 105 |
| HvLSM4_domain | 153 | HvLSM4 | 107 |
| TaLSM1_domain | 154 | TaLSM1 | 109 |
| TaLSM4a_domain | 155 | TaLSM4a | 111 |
| TaLSM4b_domain | 156 | TaLSM4b | 113 |

TABLE I2-continued

SEQ ID No. corresponding to the sequence of the
Lsm domain present in the Lsm proteins listed in Table G.

| Name | SEQ ID No. | Name of the reference Lsm protein | SEQ ID NO. of the reference Lsm protein |
|---|---|---|---|
| ZmLSM1_domain | 157 | ZmLSM1 | 115 |
| ZmLSM4a_domain | 158 | ZmLSM4a | 116 |

Example 15

Cloning of Nucleic Acid Sequence as Represented by SEQ ID NO: 40

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The Arabidopsis thalianan Lsm gene was amplified by PCR using as template an Arabidopsis thaliana seedling cDNA library (Invitrogen, Paisley, UK). Sense primer 5'-ggg-gacaagtttgt acaaaaaagcaggcttaaacaatgtcttgggctgctcct-3' (SEQ ID NO: 162) and reverse primer 5'-ggggaccactttgtacaa-gaaagctgggttttctacaatgctgcaacaca-3' (SEQ ID NO: 163) which include the AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombines in vivo with the pDONR201 plasmid to produce, according to the Gateway terminology, an "entry clone", pLsm. Plasmid pDONR201 was purchased from Invitrogen, as part of the Gateway® technology.

Example 16

Expression Vector Construction Using the Nucleic Acid Sequence as Represented by SEQ ID NO: 40

The entry clone pLsm was subsequently used in an LR reaction with pWSI18, a destination vector used for Oryza sativa transformation. This vector contains as functional elements within the T-DNA borders: a plant selecTable marker; a screenable marker expression cassette; and a Gateway cassette intended for LR in vivo recombination with the nucleic acid sequence of interest already cloned in the entry clone. A rice WSI18 promoter (SEQ ID NO: 157) for constitutive expression was located upstream of this Gateway cassette.

Figure 11:
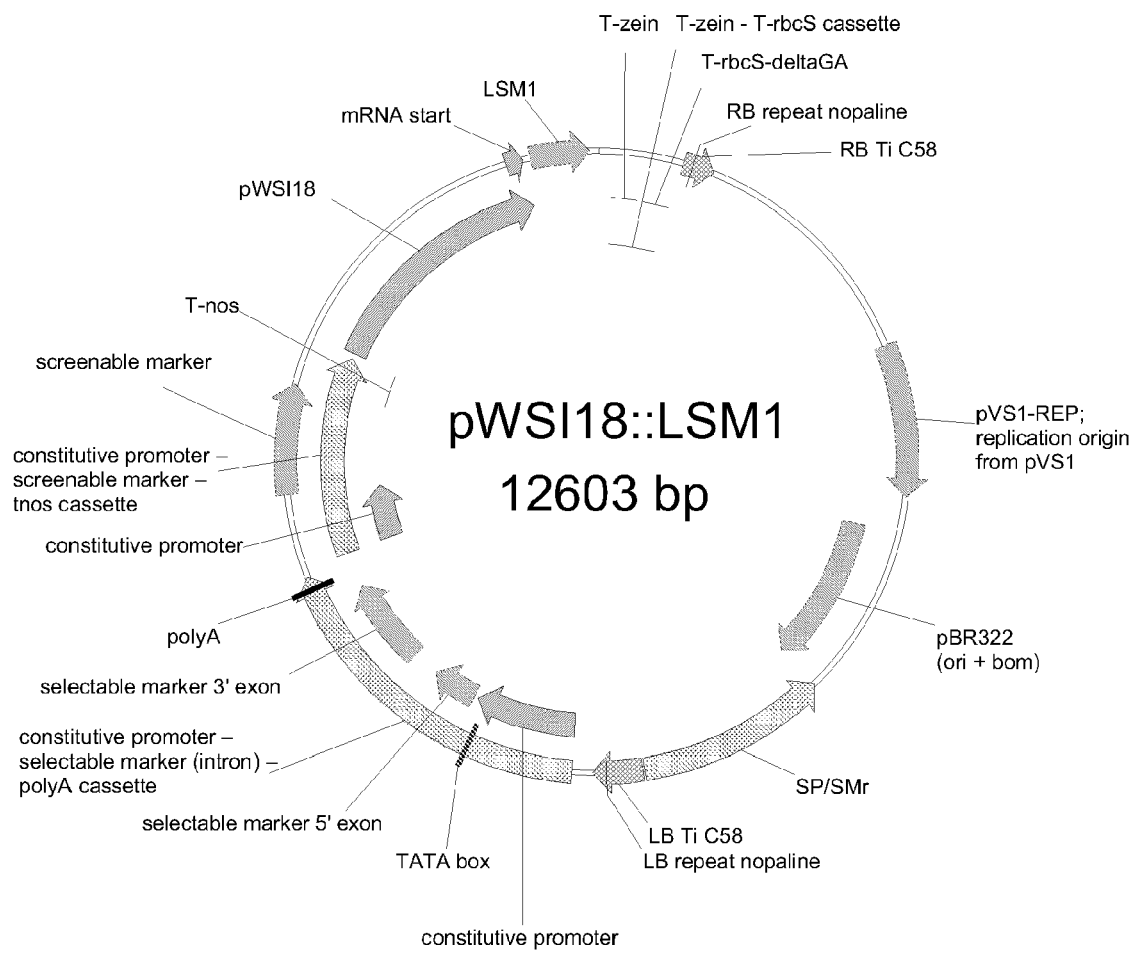
FIG. 11 shows the binary vector for increased expression in *Oryza sativa* of an *Arabidopsis thalianan* Lsm protein-encoding nucleic acid under the control of a WSI18 promoter.
Figure 13:
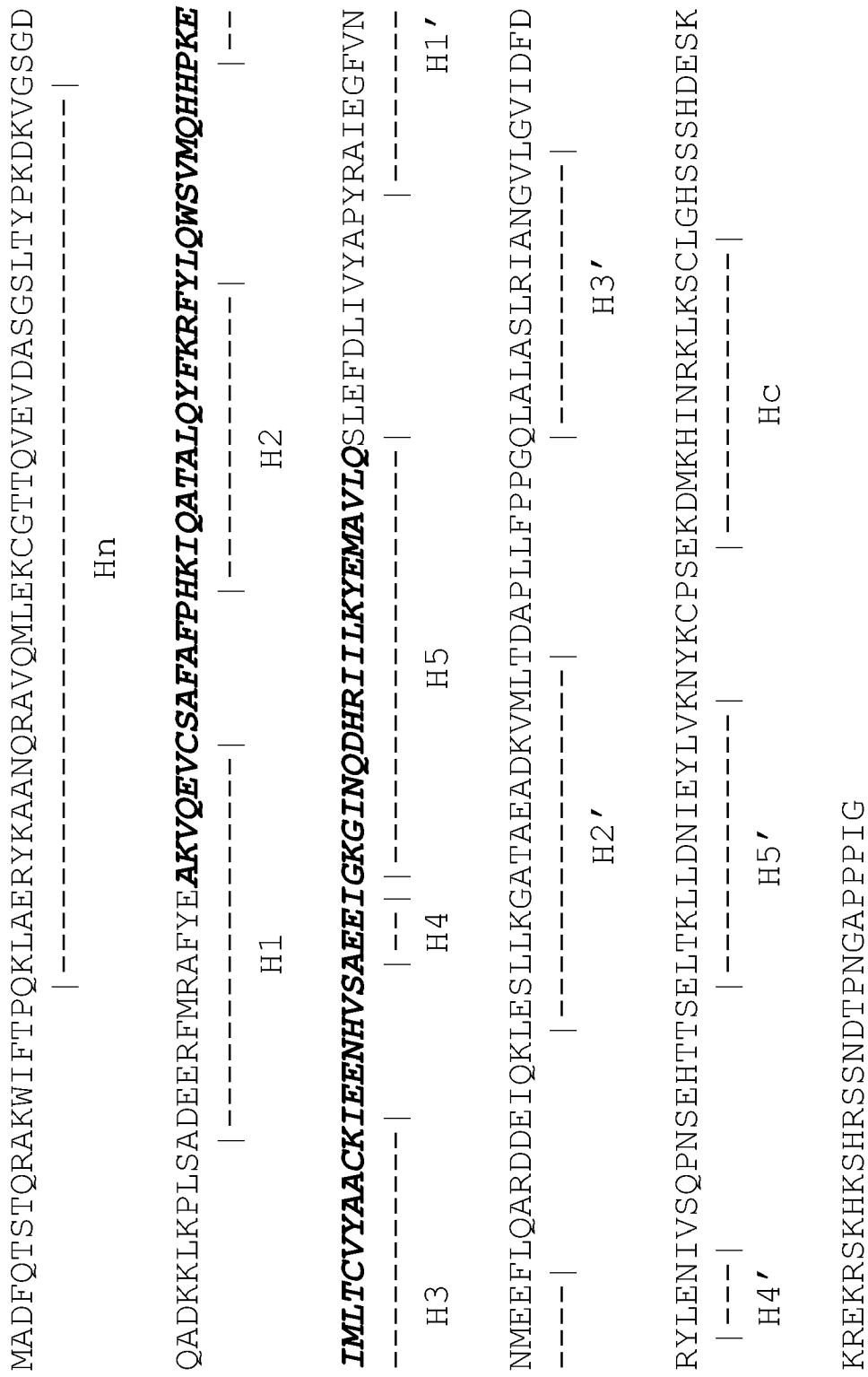
FIG. 13 shows the sequence of SEQ ID NO: 173 with the cyclin box indicated in bold. The various helix domains (Hn, H1, H2, H3, H4, H5, H1', H2', H3', H4', H5' and Hc) as discriminated by Andersen et al. (1997) are indicated.

After the LR recombination step, the resulting expression vector pWSI18::Lsm (FIG. 11) was transformed into Agrobacterium strain LBA4044 according to methods well known in the art.

Example 17

Plant Transformation

Rice Transformation

The Agrobacterium containing the expression vector was used to transform Oryza sativa plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

Agrobacterium strain LBA4404 containing the expression vector was used for co-cultivation. Agrobacterium was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (Zea mays) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with Agrobacterium tumefaciens containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C.

for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L $K_2SO_4$, and 100 μm acetosyringinone. The explants are washed in half-strength Murashige-Skoog medium (Murashige and Skoog, 1962) and plated on the same SH induction medium without acetosyringinone but with a suiTable selection agent and suiTable Antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 18

Phenotypic Evaluation Procedure 18.1 Evaluation Setup

Approximately 35 independent T0 rice transformants were generated. The primary transformants were transferred from a tissue culture chamber to a greenhouse for growing and harvest of T1 seed. Five events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants were evaluated under different watering regimes. In Regime 1, the watering was performed on daily bases with enough water supplied to satisfy the needs of the plants to achieve optimal growth without causing any symptom of water deficit. In Regime 2 the watering was temporarily reduced at heading time, until visible symptoms of water deficit manifested as leaf rolling was seen in the control plants. Under the latter conditions, the water content in the soil dropped below 20%.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

18.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

18.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles. The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 19

Results of the Phenotypic Evaluation of the Transgenic Plants

The results of the evaluation of transgenic rice plants expressing the nucleic acid sequence useful in performing the methods of the invention are presented in Table J. The percentage difference between the transgenics and the corresponding nullizygotes is also shown.

Total seed yield, number of filled seeds, seed fill rate and harvest index are significantly increased in the transgenic plants expressing the nucleic acid sequence useful in performing the methods of the invention, compared to the control plants (in this case, the nullizygotes).

TABLE J

Results of the evaluation of transgenic rice plants expressing
the nucleic acid sequence useful in performing the methods
of the invention.

| Trait | % Increase under watering regime 1 | % Increase under watering regime 2 |
|---|---|---|
| Total seed yield | 27 | 27 |
| Number of filled seeds | 25 | 25 |
| Fill rate | 27 | 14 |
| Biomass | 1 | 5 |
| Harvest index | 25 | 21 |

Rice plants transformed with a nucleic acid encoding the protein of SEQ ID NO: 47 and under control of the rice GOS2 promoter, were grown under watering regime 2. At least one event showed an increase in one or more of: vegetative biomass, early vigour, total seed weight, number of filled seeds, total number of seeds.

Example 20

Identification of Sequences Related to SEQ ID NO: 165 and SEQ ID NO: 166

Sequences (full length cDNA, ESTs or genomic) related to SEQ ID NO: 165 and/or protein sequences related to SEQ ID NO:166 were identified amongst those maintained in the Entrez Nucleotides database at the National Center for Biotechnology Information (NCBI) using SEQ ID NO: 172 and/or SEQ ID NO: 173, and database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 173 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

Table K provides a list of nucleic acid and protein sequences related to the nucleic acid sequence as represented by SEQ ID NO: 165 and the protein sequence represented by SEQ ID NO: 166.

TABLE K

Nucleic acid sequences encoding CycH$_T$- polypeptides and CycH$_T$- polypeptides.

| Name | Source organism | Nucleic acid SEQ ID NO: | Polypeptide SEQ ID NO: |
|---|---|---|---|
| AtCycH$_T$- | Arabidopsis thaliana | 165 | 166 |
| AtCycH1 | Arabidopsis thaliana | 172 | 173 |
| CAK associated cyclinH homolog | Populus tremula x Populus tremuloides | 174 | 175 |

TABLE K-continued

Nucleic acid sequences encoding CycH$_T$- polypeptides and CycH$_T$- polypeptides.

| Name | Source organism | Nucleic acid SEQ ID NO: | Polypeptide SEQ ID NO: |
|---|---|---|---|
| cycH-1 | Oryza sativa | 176 | 177 |
| CycH | Lycopersicon esculentum | 178 | 179 |
| CycH | Zea mays | 180 | 181 |
| CycH | Triticum aestivum | 182 | 183 |
| CycH | Aquilegia formosa | 184 | 185 |
| CycH | Solanum tuberosum | 186 | 187 |
| CycH | Saccharum officinarum | 188 | 189 |
| CycH | Ostreococcus tauri | 190 | 191 |
| CycH | Drosophila melanogaster | 192 | 193 |
| CycH | Homo sapiens | 194 | 195 |
| CycH | Phaeodactylum tricornutum | 196 | 197 |

Example 21

Alignment of CycH Polypeptide Sequences

Figure 14:
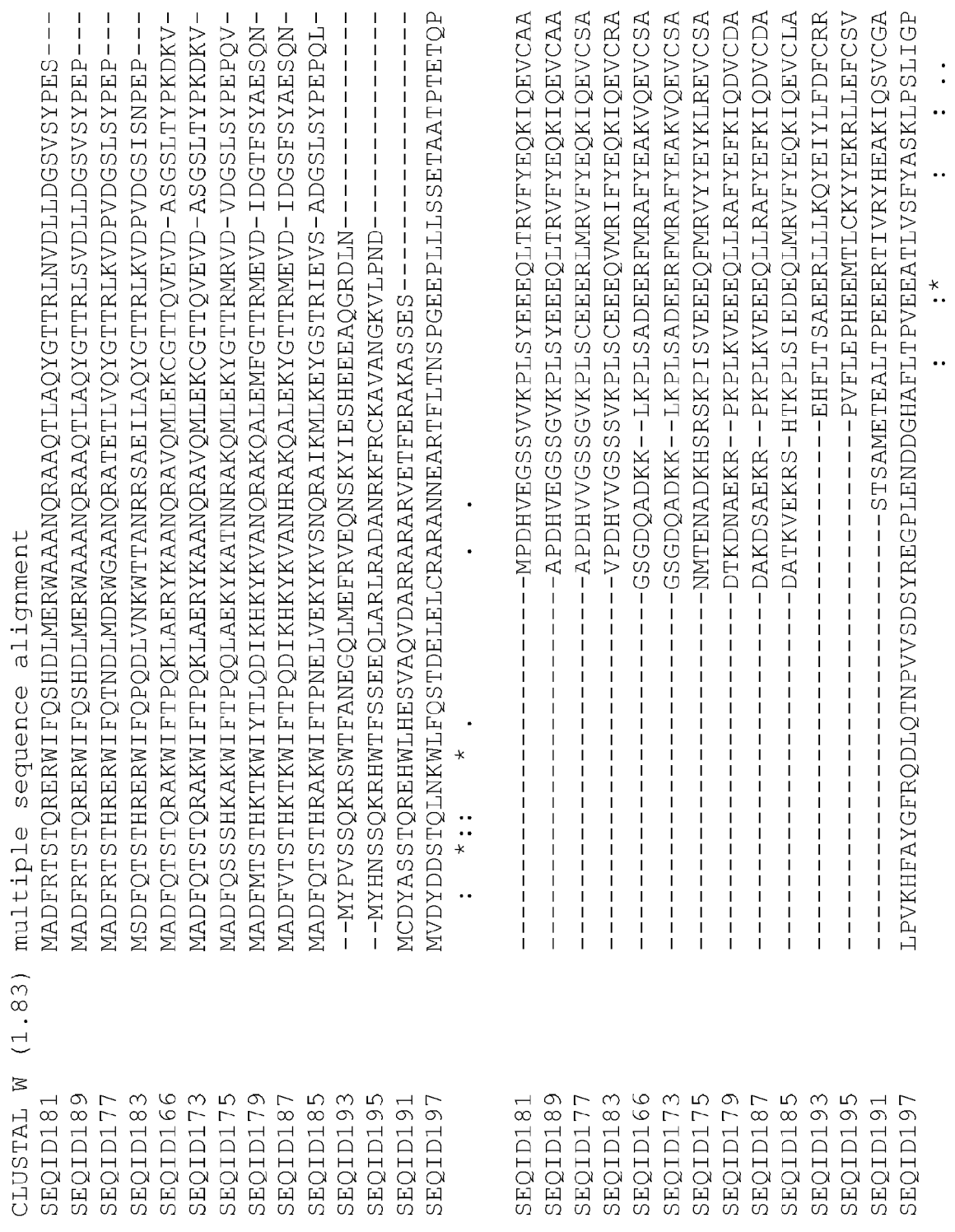

Alignment of polypeptide sequences was performed using the ClustalW (1.83) algorithm. Alternatively, the AlignX programme from Vector NTI (Invitrogen) which is also based on the popular Clustal algorithm of progressive alignment (Thompson et al. (1997) Nucleic Acids Res 25:4876-4882; Chema et al. (2003). Nucleic Acids Res 31:3497-3500) may be used. Default values are for the gap open penalty of 10, for the gap extension penalty of 0, 1 and the selected weight matrix is Blosum 62 (if polypeptides are aligned). Results in FIG. 14 show that CycH polypeptides share regions of high sequence conservation.

Figure 15:
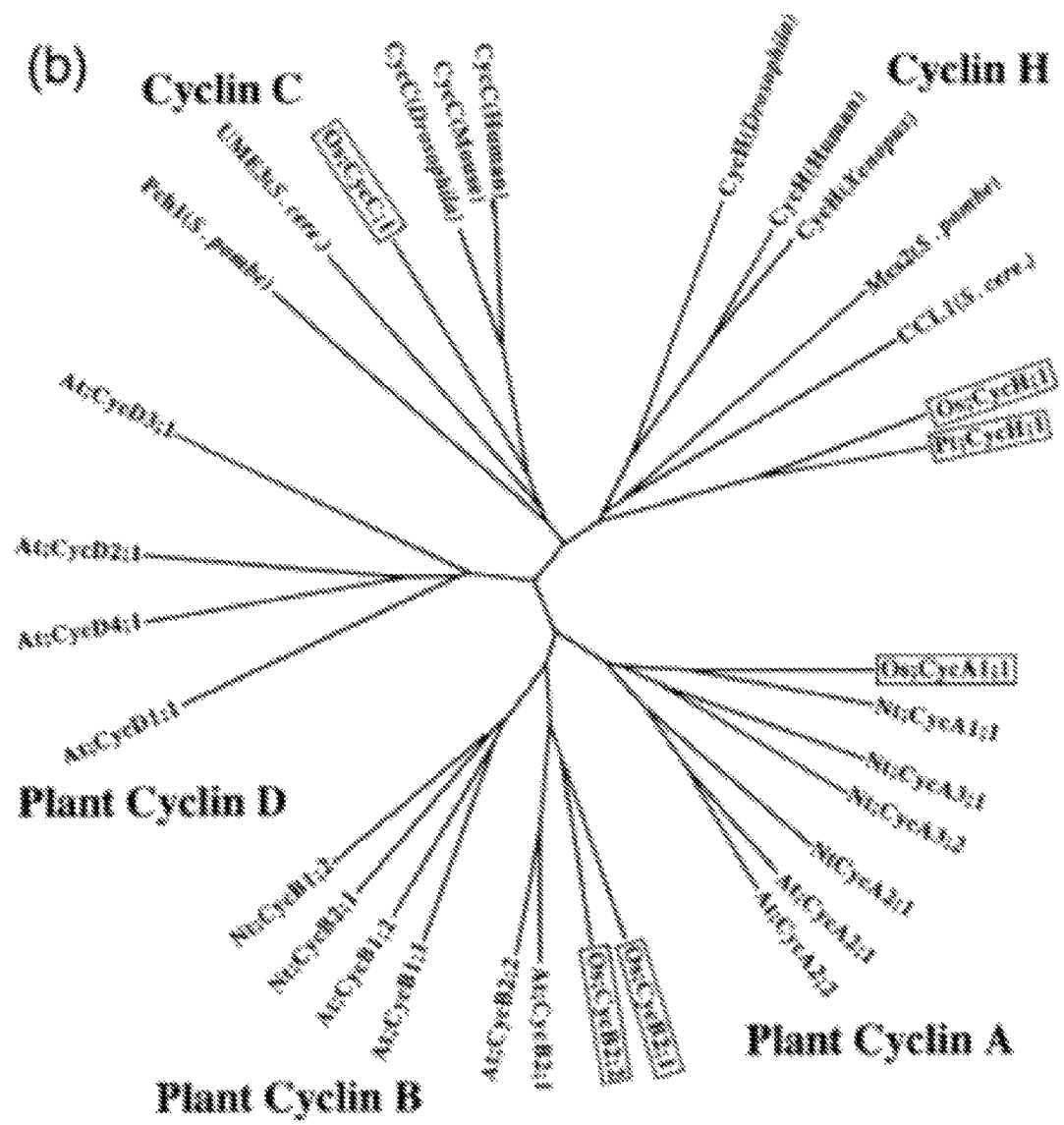
FIG. 15 shows a phylogenetic tree comprising various cyclin polypeptide sequences (Yamaguchi et al., Plant J. 24, 11-20, 2000). Sequences clustering with Cyclin H (such as the sequence of SEQ ID NO: 166 or SEQ ID NO: 173) may be useful in performing the methods of the invention.

A phylogenetic tree of CycH$_T$- polypeptides was constructed using standard techniques. FIG. 15 shows how CycH polypeptides cluster together.

Example 22

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (Campanella et al., BMC Bioinformatics. 2003 4:29. MatGAT: an application that generates similarity/identity matrices using protein or DNA sequences). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table L for the global similarity and identity over the full length of the polypeptide sequences (excluding the partial polypeptide sequences). Percentage identity is given above the diagonal in bold and percentage similarity is given below the diagonal (normal face).

The percentage identity between the CycH polypeptide sequences useful in performing the methods of the invention can be as low as 22% amino acid identity compared to SEQ ID NO: 173.

Example 24

Topology Prediction of the Polypeptide Sequences Useful in Performing the Methods of the Invention (Subcellular Localization, Transmembrane . . . )

TargetP 1.1 predicts the subcellular location of eukaryotic proteins. The location assignment is based on the predicted

TABLE L

MatGAT results for global similarity and identity over the full length of the polypeptide sequences.

| | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| 1. SEQID166 | | 61.3 | 44.0 | 39.9 | 40.5 | 38.5 | 38.4 | 41.8 | 44.3 | 42.4 | 20.2 | 19.9 | 23.7 | 14.2 |
| 2. SEQID173 | 63.1 | | 64.2 | 56.4 | 56.5 | 54.9 | 54.1 | 59.8 | 53.1 | 51.9 | 31.2 | 25.4 | 29.3 | 22.7 |
| 3. SEQID175 | 54.2 | 82.1 | | 58.6 | 58.2 | 57.3 | 55.6 | 64.0 | 57.7 | 53.0 | 30.5 | 23.4 | 29.0 | 21.9 |
| 4. SEQID177 | 51.5 | 75.0 | 78.9 | | 57.3 | 83.1 | 81.3 | 64.4 | 54.5 | 78.2 | 31.0 | 25.9 | 30.9 | 22.5 |
| 5. SEQID179 | 51.5 | 72.0 | 74.7 | 72.4 | | 55.7 | 54.6 | 60.5 | 84.8 | 52.3 | 31.3 | 27.7 | 30.6 | 21.6 |
| 6. SEQID181 | 51.4 | 73.2 | 78.3 | 91.2 | 69.6 | | 78.7 | 60.7 | 53.8 | 89.1 | 32.0 | 26.9 | 30.1 | 23.9 |
| 7. SEQID183 | 50.6 | 74.4 | 76.5 | 90.7 | 71.1 | 87.7 | | 61.7 | 52.7 | 72.9 | 30.1 | 24.6 | 30.6 | 22.0 |
| 8. SEQID185 | 53.9 | 77.7 | 79.6 | 82.3 | 75.4 | 78.1 | 78.7 | | 58.3 | 57.4 | 31.5 | 25.6 | 29.3 | 20.6 |
| 9. SEQID187 | 54.8 | 66.7 | 71.1 | 67.3 | 88.7 | 64.7 | 66.9 | 70.4 | | 55.8 | 29.6 | 24.2 | 28.7 | 20.4 |
| 10. SEQID189 | 54.5 | 68.5 | 72.3 | 86.4 | 66.2 | 90.3 | 81.6 | 73.4 | 68.8 | | 29.9 | 26.6 | 28.4 | 22.2 |
| 11. SEQID191 | 36.3 | 53.3 | 53.0 | 53.3 | 53.0 | 54.1 | 50.9 | 54.5 | 50.3 | 50.9 | | 25.1 | 27.9 | 22.7 |
| 12. SEQID193 | 34.6 | 45.5 | 46.1 | 50.3 | 48.2 | 48.9 | 49.7 | 49.1 | 44.1 | 46.6 | 46.6 | | 43.2 | 19.3 |
| 13. SEQID195 | 38.1 | 50.9 | 52.4 | 54.2 | 51.8 | 51.4 | 53.9 | 51.5 | 48.9 | 50.2 | 48.9 | 63.3 | | 22.0 |
| 14. SEQID197 | 24.8 | 38.8 | 38.5 | 39.7 | 35.8 | 39.9 | 36.9 | 37.6 | 33.7 | 36.7 | 36.2 | 32.8 | 36.2 | |

Example 23

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 173 are presented in Table M.

TABLE M

InterPro scan results of the polypeptide sequence as represented by SEQ ID NO: 173

| Database | Accession number | Accession name |
|---|---|---|
| Interpro | IPR006670 | cyclin |
| Interpro | IPR011028 | Cyclin-like |
| SMART | SM00385 | cyclin |
| PANTHER | PTHR10026 | SF8 CYCLIN H |
| SUPERFAMILY | SSF47954 | Cyclin-like | presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 173 are presented Table N. The "plant" organism group has been selected, no cutoffs defined, and the predicted length of the transit peptide requested. The subcellular localization of the polypeptide sequence as represented by SEQ ID NO: 173 is likely the cytoplasm or nucleus. However, it should be noticed that the observed effects on yield as described in the present application are not the result of a particular localisation of the protein.

TABLE N

TargetP 1.1 analysis of the polypeptide sequence as represented by SEQ ID NO: 173

| | |
|---|---|
| Length (AA) | 336 |
| Chloroplastic transit peptide | 0.109 |
| Mitochondrial transit peptide | 0.416 |
| Secretory pathway signal peptide | 0.083 |

TABLE N-continued

TargetP 1.1 analysis of the polypeptide sequence as represented by SEQ ID NO: 173

| | |
|---|---|
| Other subcellular targeting | 0.551 |
| Predicted Location | other |
| Reliability class | 5 |
| Predicted transit peptide length | / |

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark Example 25

Assay Related to the Polypeptide Sequences Useful in Performing the Methods of the Invention The yeast two hybrid system is used to determine the interaction between a CycHTr protein and the CAK protein (Yamaguchi et al., 2000). Briefly, CAK, fused to the GAL4-DNA binding domain (DNA-BD) and CycH$_{Tr}$ fused to the GAL4-transactivation domain (AD) are produced in the *Saccharomyces cerevisiae* Y190 strain, which has HIS3 and LacZ reporter genes under the consensus sequences of the GAL4 binding site. Expression of CAK or CycHTr does not induce the expression of reporter genes, while cells expressing both CAK and CycHTr fusion proteins can grow on a medium without histidine and express the LacZ protein.

Activation of CAK by CycH is measured as described by Yamaguchi (2000). In budding yeast, Civ1/Cak1 has a CAK activity but not CTD-kinase activity in vivo. It was demonstrated that overexpression of rice CAK (R2) was able to complement CAK mutation in the budding yeast strain GF2351, which carries a temperature-sensitive mutation in the civ1/cak1 gene. When CAK (cloned into the expression vector pYES2, which contains the galactose-inducible GAL1 promoter), CycH (cloned into the constitutive expression vector pGAD-GL, which contains truncated adh promoter and expresses GAL4 transactivation domain fused to CycH) or both are introduced into GF2351 cells, then cells expressing CAK grow at 34° C. on galactose-containing minimal medium (MVGS) but not on a glucose-containing minimal medium (MVD). Cells expressing only CycH can not grow at 34° C. In contrast, cells expressing both CAK and CycH grow on the MVGS medium at 36° C., but at this temperature those expressing only CAK are unable to grow. This indicates that expression of CycH enhances the suppressive activity of CAK on the civ1/cak1 mutation in budding yeast cells. In contrast, when CycH$_{Tr}$ is used instead of CycH, no activation is observed.

Furthermore, overexpression of a CycHTr protein in a plant results in increased seed yield as described below.

Example 26

Cloning of Nucleic Acid Sequence as Represented by SEQ ID NO: 165

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* CycH$_{Tr}$ gene was amplified by PCR using as template an *Arabidopsis thaliana* cDNA library (Invitrogen, Paisley, UK). Primers (SEQ ID NO: 167; sense: 5'-ggggacaagtttgtacaaaaaagcag-gcttcacaatggcggattttcagacatc-3') and SEQ ID NO: 168; reverse, complementary: 5'-ggggaccactttgtacaagaaagctggg-taaactcaacc tatgggtggc-3'), which include the AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Example 27

Expression Vector Construction Using the Nucleic Acid Sequence as Represented by SEQ ID NO: 165

The entry clone comprising SEQ ID NO: 165 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice oleosin or WSI18 promoter (SEQ ID NO: 170 or SEQ ID NO: 171) for seed specific expression was located upstream of this Gateway cassette.

Figure 16:
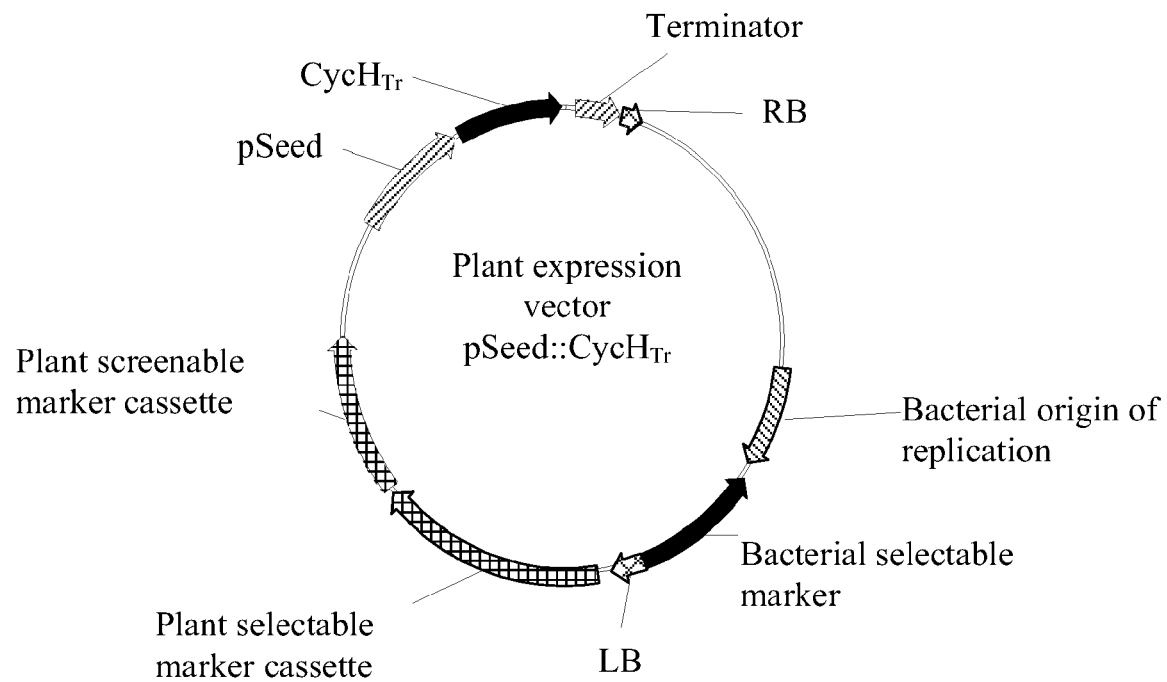
FIG. 16 shows the binary vector for increased expression in *Oryza sativa* of an *Arabidopsis thaliana* CycH$_{Tr}$ protein-encoding nucleic acid under the control of a seed specific promoter.
Figure 18:
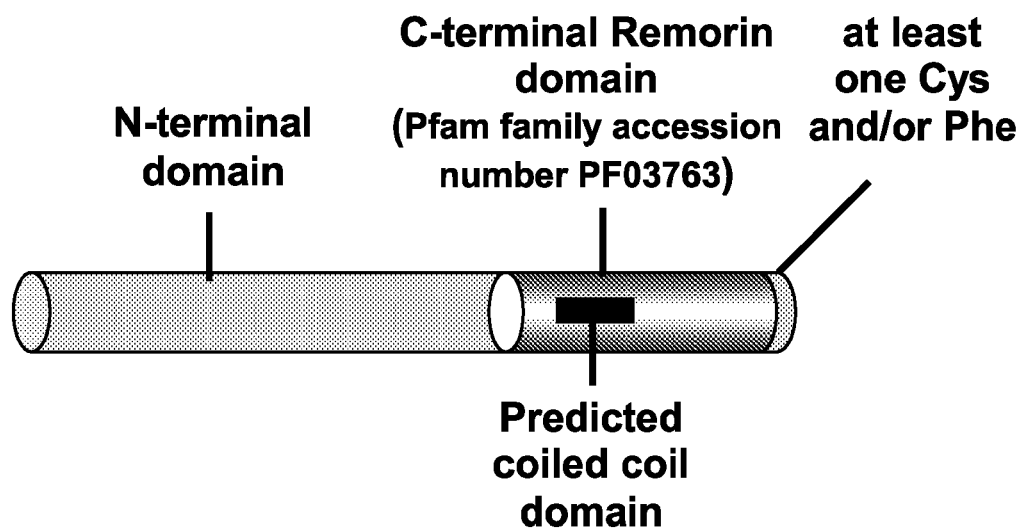
FIG. 18 shows a scheme representing the structure of Remorins. The C-terminal Remorin domain is indicated (which corresponds to Pfam family accession number PF03763), the N-terminal domain (comprising the amino acid residues from the N-terminus to the last amino acid residue upstream of the C-terminal Remorin domain, from N-terminus to C-terminus), and the last ten amino acid residues at the C-terminus of the polypeptide, comprising at least one Cys and/or one Phe, are illustrated.
Figure 19:
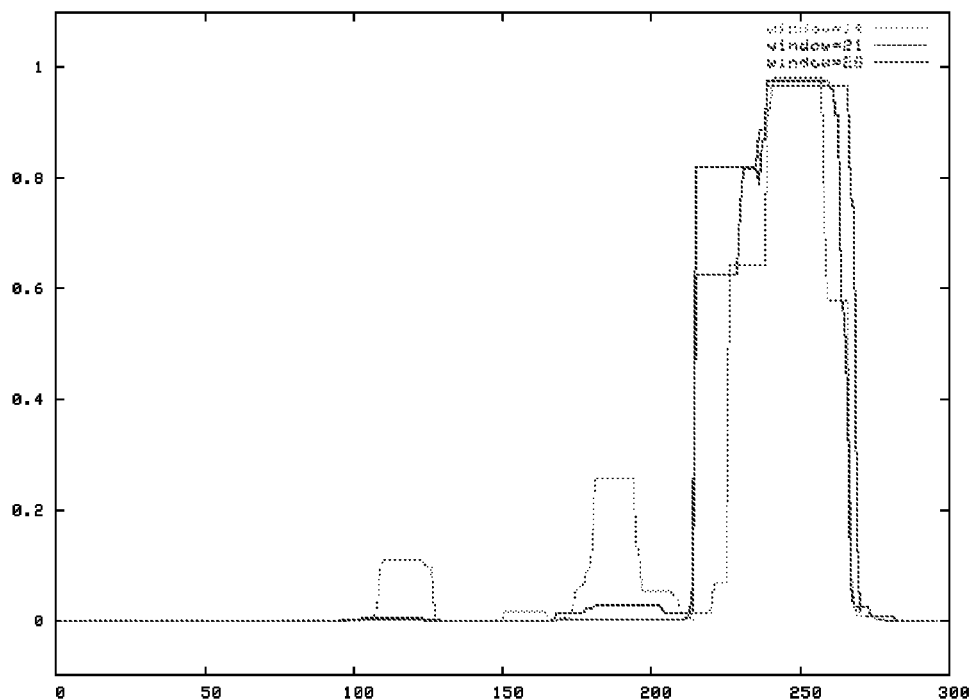
FIG. 19 shows the graphical output of the COILS algorithm predicting a coiled coil domain in the C-terminal half of the polypeptide as represented by SEQ ID NO: 199. The X axis represents the amino acid residue coordinates, the Y axis the probability (ranging from 0 to 1) that a coiled coil domain is present, and the three lines, the three windows (14, 21, 28) examined.

After the LR recombination step, the resulting expression vector pSeed::CycH$_{Tr}$ (FIG. 16) was transformed into *Agrobacterium* strain LBA4044 according to methods well known in the art.

Example 28

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% HgCl$_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119:

839-847) or LBA4404 containing the expression vector. The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 µg/ml cefotaxime. The seeds are then transferred to SH-medium with 50 µg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 29

Phenotypic Evaluation Procedure 29.1 Evaluation Setup

Approximately 35 independent T0 rice transformants were generated. The primary transformants were transferred from a tissue culture chamber to a greenhouse for growing and harvest of T1 seed. Seven events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approach the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

29.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P-values were obtained by comparing likelihood ratio test to chi square distributions.

29.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area (mm$^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 30

Results of the Phenotypic Evaluation of the Transgenic Plants

The results of the evaluation of transgenic rice plants expressing the CycH$_{Tr}$ nucleic acid under control of a seed specific promoter showed there was, compared to the control plants, an increase for one of more of the following parameters: vegetative biomass (AreaMax), root/shoot index, total seed weight (totwgseeds), number of filled seeds (nrfilledseeds), fill rate (fillrate), number of flowers per panicle (flowperpan), Harvest Index (HI), Thousand Kernel Weight (TKW), total number of seeds (nrtotalseed).

For the construct with the oleosin promoter, the increased parameters included the ones given in Table O.

TABLE O increased seed yield parameters for plants with the CycH$_{Tr}$-transgene under control of a oleosin promoter, in T1 and T2 stage

| Parameter | T1 | | T2 | | Combined |
|---|---|---|---|---|---|
| | % increase | p-value | % increase | p-value | p-value |
| AreaMax | 13 | 0.0020 | 30 | 0.0000 | 0.0000 |
| Totwgseeds | 22 | 0.0021 | 38 | 0.0000 | 0.0000 |
| Nrfilledseeds | 23 | 0.0008 | 35 | 0.0000 | 0.0000 |
| Nrtotalseeds | 16 | 0.0011 | 32 | 0.0000 | 0.0000 |
| Harvest Index | 7 | 0.2319 | 18 | 0.0044 | 0.0000 |

Example 31

Identification of Sequences Related to SEQ ID NO: 198 and SEQ ID NO: 199

Sequences (full length cDNA, ESTs or genomic) related to SEQ ID NO: 198 and/or protein sequences related to SEQ ID NO: 199 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 199 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

Table P provides a list of nucleic acid and polypeptide sequences related to the nucleic acid sequence as represented by SEQ ID NO: 198 and the polypeptide sequence represented by SEQ ID NO: 199.

TABLE P

Nucleic acid sequences encoding Remorin polypeptides, and Remorin polypeptides.

| Name | Source organism | Nucleic acid SEQ ID NO: | Polypeptide SEQ ID NO: | Database accession number | Database accession number |
|---|---|---|---|---|---|
| Remorin | Arabidopsis thaliana | 198 | 199 | NM_115614.2 | NP_567050.1 |
| remorin | Arabidopsis thaliana | 200 | 201 | AY086863.1 | AAM63910.1 |
| Remorin | Arabidopsis thaliana | 202 | 203 | NM_115990.3 | NP_191685.1 |
| remorin | Arabidopsis thaliana | 204 | 205 | M25268.1 | AAA57124.1 |
| remorin | Arabidopsis thaliana | 206 | 207 | BT000016.1 | AAN15335.1 |
| remorin | Arabidopsis thaliana | 208 | 209 | AF387006_1 | AAK62451.1 |
| remorin | Arabidopsis thaliana | 210 | 211 | NM_203095.1 | NP_974824.1 |
| remorin | Arabidopsis thaliana | 212 | 213 | NM_122280.2 | NP_197764.1 |

TABLE P-continued

Nucleic acid sequences encoding Remorin polypeptides, and Remorin polypeptides.

| Name | Source organism | Nucleic acid SEQ ID NO: | Polypeptide SEQ ID NO: | Database accession number | Database accession number |
|---|---|---|---|---|---|
| remorin | Arabidopsis thaliana | 214 | 215 | NM_114753.1 | NP_190463.1 |
| Remorin | Arabidopsis thaliana | 216 | 217 | NM_130145.3 | NP_182106.1 |
| hypothetical | Arabidopsis thaliana | 218 | 219 | gi|7267383 | CAB80876.1 |
| unnamed | Arabidopsis thaliana | 220 | 221 | gi|10176838 | BAB10048.1 |
| remorin | Arabidopsis thaliana | 222 | 223 | NM_116292.2 | NP_191976.2 |
| remorin | Arabidopsis thaliana | 224 | 225 | NM_179535.1 | NP_849866.1 |
| Remorin | Arabidopsis thaliana | 226 | 227 | NM_001036171.1 | NP_001031248.1 |
| Remorin | Arabidopsis thaliana | 228 | 229 | NM_105426.2 | NP_564900.1 |
| remorin | Arabidopsis thaliana | 230 | 231 | NM_125521.1 | NP_200936.1 |
| Remorin | Arabidopsis thaliana | 232 | 233 | NM_129751.1 | NP_181718.1 |
| remorin | Arabidopsis thaliana | 234 | 235 | NM_101258.1 | NP_172845.1 |
| remorin | Arabidopsis thaliana | 236 | 237 | gi|7270623 | CAB80363.1 |
| remorin | Arabidopsis thaliana | 238 | 239 | NM_104263.3 | NP_175789.2 |
| Remorin | Arabidopsis thaliana | 240 | 241 | NM_102770.3 | NP_174322.1 |
| remorin | Arabidopsis thaliana | 242 | 243 | NM_202247.1 | NP_973976.1 |
| remorin | Arabidopsis thaliana | 244 | 245 | NM_126277.1 | AAO23587.1 |
| remorin | Arabidopsis thaliana | 246 | 247 | gi|6382042 | AAC13631.1 |
| remorin | Arabidopsis thaliana | 248 | 249 | gi|12597777 | AAG60092.1 |
| remorin | Arabidopsis thaliana | 250 | 251 | gi|12325073 | AAG52495.1 |
| remorin | Arabidopsis thaliana | 252 | 253 | gi|6850877 | CAB71056.1 |
| remorin | Arabidopsis thaliana | 254 | 255 | gi|6434255 | CAB62016.1 |
| remorin | Arabidopsis thaliana | 256 | 257 | gi|6491703 | CAB66111.1 |
| remorin | Arabidopsis thaliana | 258 | 259 | gi|12324670 | AAG52296 |
| remorin | Arabidopsis thaliana | 260 | 261 | gi|20198316 | AAB63554 |
| remorin | Arabidopsis thaliana | 262 | 263 | gi|7940274 | AAF79398 |
| remorin | Oryza sativa | 264 | 265 | Os02g0824500 | NP_001048576.1 |
| remorin | Oryza sativa | 266 | 267 | Os02g0642200 | NP_001047554.1 |
| remorin | Oryza sativa | 268 | 269 | Os04g0533300 | NP_001053409.1 |
| remorin | Oryza sativa | 270 | 271 | Os10g0503800 | BAF26915.1 |
| remorin | Oryza sativa | 272 | 273 | Os07g0208600 | BAF21077.1 |
| remorin | Oryza sativa | 274 | 275 | Os03g0111200 | BAF10636.1 |
| remorin | Oryza sativa | 276 | 277 | Os07g0569100 | NP_001060036.1 |
| remorin | Oryza sativa | 278 | 279 | Os03g0808300 | NP_001051650.1 |
| remorin | Oryza sativa | 280 | 281 | Os03g0211500 | NP_001049348.1 |
| remorin | Oryza sativa | 282 | 283 | Os02g0602000 | BAF09268.1 |
| remorin | Oryza sativa | 284 | 285 | Os02g0658400 | BAF09549.1 |
| remorin | Oryza sativa | 286 | 287 | Os03g0120200 | BAF10700.1 |
| remorin | Oryza sativa | 288 | 289 | Os02g0116800 | NP_001045682.1 |
| remorin | Oryza sativa | 290 | 291 | Os04g0620200 | NP_001053905.1 |
| remorin | Oryza sativa | 292 | 293 | Os12g0613600 | BAF30284.1 |
| remorin | Oryza sativa | 294 | 295 | Os11g0616300 | BAF28646.1 |
| remorin | Oryza sativa | 296 | 297 | Os10g0325400 | BAF26266.1 |
| remorin | Oryza sativa | 298 | 299 | Os09g0456100 | BAF25275.1 |
| remorin | Oryza sativa | 300 | 301 | Os08g0471800 | NP_001062016.1 |
| remorin | Oryza sativa | 302 | 303 | Os02g0767000 | NP_001048227.1 |
| hypothetical | Zea mays | 304 | 305 | gi|23928433 | AAN40027.1 |
| remorin | Solanum tuberosum | 306 | 307 | gi|1881584 | AAB49425.1 |
| remorin | Glycine max | 308 | 309 | gi|83853825 | ABC47866.1 |
| remorin | Medicago truncatula | 310 | 311 | gi|61097833 | ABN08208.1 |
| remorin | Medicago truncatula | 312 | 313 | gi|62629912 | ABE89592.1 |
| remorin | Medicago truncatula | 314 | 315 | gi|84662897 | ABE87162.1 |
| rem-1 | Lycopersicum esculentum | 316 | 317 | gi|4731572 | AAD28506.1 |
| rem-2 | Lycopersicum esculentum | 318 | 319 | gi|4883529 | AAD28507.2 |
| remorin | Medicago truncatula | 320 | 321 | gi|49170172 | ABE84731.1 |
| remorin | Musa acuminata | 322 | 323 | gi|102140012 | ABF70164.1 |
| remorin | Medicago truncatula | 324 | 325 | gi|52694025 | ABE86981.1 |

Example 32

Alignment of Remorin Polypeptide Sequences

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chema et al. (2003). Nucleic Acids Res 31:3497-3500). Default values are for the gap open penalty of 10, for the gap extension penalty of 0, 1 and the selected weight matrix is Blosum 62 (if polypeptides are aligned).

Sequence conservation among Remorins is essentially in the C-terminal Remorin domain of the polypeptides, the N-terminal domain usually being more variable in sequence length and composition. The C-terminal Remorin domain of the Remorin polypeptides are aligned in FIG. 20. The amino acid residues comprised in the C-terminal Remorin domain of SEQ ID NO: 199 (and represented as in SEQ ID NO: 326) are marked in bold and over headed by a black box. Most of the Remorins polypeptides comprise at least one Cys and/or one Phe, in the C-terminal ten amino acid residues, as shown with a box in FIG. 20. The predicted coiled coil region is double-underlined, and a putative sumoylation site is boxed.

Example 33

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table Q for the global similarity and identity over the full length of the polypeptide sequences from *Arabidopsis*, as example (excluding the partial polypeptide sequences). Percentage identity is given above the diagonal and percentage similarity is given below the diagonal.

The percentage identity between the polypeptide sequences from *Arabidopsis thaliana* useful in performing the methods of the invention can be as low as 11% amino acid identity compared to SEQ ID NO: 199.

The percentage identity between the C-terminal Remorin domain of *Arabidopsis thaliana* Remorin polypeptides, such as the C-terminal Remorin domain of SEQ ID NO: 199 represented in SEQ ID NO: 326, is shown in Table Q1. The percentage identity between the Remorin domain of SEQ ID NO: 326 and other *Arabidopsis thaliana* Remorin C-terminal Remorin domains is increased to 16% amino acid identity.

TABLE Q

MatGAT results for global similarity and identity over the full length of the *Arabidopsis thaliana* Remorin polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. gi\|18410744\|ref\|NP_567050.1\| DNA binding [*Arabidopsis thaliana*] AT3G57540 | | 23 | 21 | 21 | 22 | 19 | 11 | 13 | 12 | 17 | 25 | 19 |
| 2. gi\|21555669\|gb\|AAM63910.1\| remorin [*Arabidopsis thaliana*] like At5g27350 | 37 | | 55 | 53 | 99 | 64 | 21 | 25 | 17 | 15 | 20 | 19 |
| 3. gi\|15233068\|ref\|NP_191685.1\| binding [*Arabidopsis thaliana*] AT3G61260 | 36 | 69 | | 67 | 55 | 52 | 19 | 20 | 18 | 17 | 20 | 21 |
| 4. gi\|601843\|gb\|AAA57124.1\| DNA-binding protein | 36 | 68 | 78 | | 51 | 54 | 23 | 26 | 16 | 14 | 19 | 20 |
| 5. gi\|42573455\|ref\|NP_974824.1\| DNA binding [*Arabidopsis thaliana*] AT5G23750 | 37 | 99 | 68 | 66 | | 64 | 21 | 25 | 17 | 15 | 20 | 18 |
| 6. gi\|15229057\|ref\|NP_190463.1\| DNA binding [*Arabidopsis thaliana*] AT3G48940 | 33 | 73 | 61 | 66 | 74 | | 23 | 27 | 17 | 15 | 17 | 17 |
| 7. gi\|7267406\|emb\|CAB80876.1\| hypothetical protein [*Arabidopsis thaliana*] AT4g00670 SPLICE | 21 | 36 | 37 | 41 | 37 | 40 | | 84 | 23 | 9 | 9 | 14 |
| 8. gi\|79458120\|ref\|NP_191976.2\| DNA binding [*Arabidopsis thaliana*] AT4G00670 SPLICE | 25 | 40 | 40 | 45 | 41 | 47 | 88 | | 25 | 8 | 10 | 10 |
| 9. gi\|30697834\|ref\|NP_849866.1\| DNA binding [*Arabidopsis thaliana*] AT1G69325 | 21 | 29 | 29 | 31 | 29 | 33 | 45 | 46 | | 12 | 11 | 14 |
| 10. gi\|79320867\|ref\|NP_001031248.1\| DNA binding [*Arabidopsis thaliana*] AT1G67590 | 33 | 31 | 30 | 31 | 32 | 28 | 21 | 19 | 23 | | 81 | 17 |
| 11. gi\|18408804\|ref\|NP_564900.1\| DNA binding [*Arabidopsis thaliana*] AT1G67590 | 37 | 31 | 34 | 32 | 31 | 29 | 18 | 19 | 20 | 83 | | 16 |
| 12. gi\|15240195\|ref\|NP_200936.1\| DNA binding [*Arabidopsis thaliana*] AT5G61280 | 37 | 34 | 36 | 35 | 35 | 31 | 26 | 24 | 24 | 32 | 34 | |
| 13. gi\|15227454\|ref\|NP_181718.1\| DNA binding [*Arabidopsis thaliana*] AT2G41870 | 73 | 38 | 41 | 38 | 39 | 38 | 24 | 27 | 23 | 34 | 35 | 39 |
| 14. gi\|15222980\|ref\|NP_172845.1\| DNA binding [*Arabidopsis thaliana*] AT1G13920 | 36 | 29 | 29 | 27 | 29 | 24 | 19 | 20 | 24 | 33 | 36 | 39 |
| 15. gi\|7270646\|emb\|CAB80363.1\| hypothetical protein [*Arabidopsis thaliana*] AT4g36970 | 37 | 25 | 27 | 25 | 25 | 22 | 15 | 15 | 14 | 32 | 37 | 24 |
| 16. gi\|42562741\|ref\|NP_175789.2\| DNA binding [*Arabidopsis thaliana*] AT1G53860 | 31 | 25 | 28 | 25 | 25 | 22 | 17 | 18 | 14 | 34 | 38 | 27 |
| 17. gi\|15220725\|ref\|NP_174322.1\| DNA binding [*Arabidopsis thaliana*] AT1G30320 | 30 | 23 | 25 | 23 | 22 | 20 | 13 | 14 | 12 | 32 | 37 | 26 |
| 18. gi\|42571771\|ref\|NP_973976.1\| unknown protein [*Arabidopsis thaliana*] AT1G45207 | 26 | 18 | 19 | 18 | 19 | 16 | 14 | 15 | 13 | 25 | 30 | 24 |
| 19. gi\|27764932\|gb\|AAO23587.1\| At2g02170/F5O4.6 [*Arabidopsis thaliana*] | 32 | 24 | 25 | 23 | 23 | 23 | 13 | 14 | 14 | 38 | 44 | 28 |
| 20. gi\|12597780\|gb\|AAG60092.1\|AC073178_3 hypothetical protein [*Arabidopsis thaliana*] | 32 | 37 | 36 | 37 | 37 | 36 | 27 | 29 | 57 | 28 | 30 | 38 |
| 21. gi\|12325086\|gb\|AAG52495.1\|AC018364_13 hypothetical protein; 34983-33172 [*Arabidopsis thaliana*] | 28 | 35 | 34 | 39 | 33 | 40 | 30 | 31 | 57 | 25 | 26 | 32 |

| | 13 | 14 | 15 | 16 | 17 | 18 | 19 | 20 | 21 |
|---|---|---|---|---|---|---|---|---|---|
| 1. gi\|18410744\|ref\|NP_567050.1\| DNA binding [*Arabidopsis thaliana*] AT3G57540 | 62 | 18 | 19 | 18 | 18 | 16 | 19 | 20 | 16 |
| 2. gi\|21555669\|gb\|AAM63910.1\| remorin [*Arabidopsis thaliana*] like At5g27350 | 23 | 17 | 14 | 12 | 14 | 11 | 16 | 20 | 19 |
| 3. gi\|15233068\|ref\|NP_191685.1\| binding [*Arabidopsis thaliana*] AT3G61260 | 24 | 19 | 15 | 17 | 15 | 12 | 16 | 20 | 18 |
| 4. gi\|601843\|gb\|AAA57124.1\| DNA-binding protein | 22 | 15 | 15 | 15 | 14 | 11 | 14 | 18 | 18 |
| 5. gi\|42573455\|ref\|NP_974824.1\| DNA binding [*Arabidopsis thaliana*] AT5G23750 | 23 | 17 | 14 | 12 | 14 | 12 | 16 | 22 | 18 |
| 6. gi\|15229057\|ref\|NP_190463.1\| DNA binding [*Arabidopsis thaliana*] AT3G48940 | 22 | 14 | 12 | 13 | 14 | 10 | 15 | 18 | 17 |
| 7. gi\|7267406\|emb\|CAB80876.1\| hypothetical protein [*Arabidopsis thaliana*] AT4g00670 SPLICE | 14 | 13 | 9 | 10 | 8 | 9 | 7 | 14 | 15 |
| 8. gi\|79458120\|ref\|NP_191976.2\| DNA binding [*Arabidopsis thaliana*] AT4G00670 SPLICE | 16 | 12 | 7 | 10 | 7 | 10 | 7 | 16 | 15 |
| 9. gi\|30697834\|ref\|NP_849866.1\| DNA binding [*Arabidopsis thaliana*] AT1G69325 | 14 | 17 | 7 | 8 | 7 | 9 | 8 | 57 | 55 |
| 10. gi\|79320867\|ref\|NP_001031248.1\| DNA binding [*Arabidopsis thaliana*] AT1G67590 | 18 | 16 | 19 | 20 | 22 | 15 | 25 | 13 | 14 |
| 11. gi\|18408804\|ref\|NP_564900.1\| DNA binding [*Arabidopsis thaliana*] AT1G67590 | 24 | 19 | 22 | 24 | 26 | 18 | 30 | 16 | 14 |
| 12. gi\|15240195\|ref\|NP_200936.1\| DNA binding [*Arabidopsis thaliana*] AT5G61280 | 20 | 27 | 14 | 16 | 13 | 14 | 17 | 21 | 16 |
| 13. gi\|15227454\|ref\|NP_181718.1\| DNA binding [*Arabidopsis thaliana*] AT2G41870 | | 20 | 19 | 16 | 18 | 14 | 18 | 23 | 20 |
| 14. gi\|15222980\|ref\|NP_172845.1\| DNA binding [*Arabidopsis thaliana*] AT1G13920 | 38 | | 16 | 20 | 18 | 16 | 19 | 24 | 21 |
| 15. gi\|7270646\|emb\|CAB80363.1\| hypothetical protein [*Arabidopsis thaliana*] AT4g36970 | 34 | 30 | | 20 | 18 | 25 | 22 | 14 | 12 |

TABLE Q-continued

MatGAT results for global similarity and identity over the full length of the *Arabidopsis thaliana* Remorin polypeptide sequences.

| | | | | | | | | | |
|---|---|---|---|---|---|---|---|---|---|
| 16. gi|42562741|ref|NP_175789.2| DNA binding [*Arabidopsis thaliana*] AT1G53860 | 27 | 32 | 36 | | 26 | 19 | 25 | 13 | 10 |
| 17. gi|15220725|ref|NP_174322.1| DNA binding [*Arabidopsis thaliana*] AT1G30320 | 29 | 31 | 37 | 44 | | 22 | 38 | 11 | 11 |
| 18. gi|42571771|ref|NP_973976.1| unknown protein [*Arabidopsis thaliana*] AT1G45207 | 23 | 28 | 40 | 32 | 35 | | 22 | 12 | 11 |
| 19. gi|27764932|gb|AAO23587.1| At2g02170/F5O4.6 [*Arabidopsis thaliana*] | 30 | 34 | 38 | 45 | 55 | 36 | | 12 | 11 |
| 20. gi|12597780|gb|AAG60092.1|AC073178_3 hypothetical protein [*Arabidopsis thaliana*] | 35 | 37 | 25 | 23 | 21 | 20 | 22 | | 84 |
| 21. gi|12325086|gb|AAG52495.1|AC018364_13 hypothetical protein; 34983-33172 [*Arabidopsis thaliana*] | 29 | 33 | 21 | 19 | 19 | 18 | 19 | 84 | |

TABLE Q1

MatGAT results for global similarity and identity between the C-terminal Remorin domain of the Remorin polypeptide sequences.

| | 1 | 2 | 3 | 4 | 5 | 6 | 7 | 8 | 9 |
|---|---|---|---|---|---|---|---|---|---|
| 1. gi|18410744|ref|NP_567050.1| DNA binding [*Arabidopsis thaliana*] AT3G57540 | | 33 | 33 | 32 | 31 | 21 | 25 | 16 | 26 |
| 2. gi|21555669|gb|AAM63910.1| remorin [*Arabidopsis thaliana*] like At5g27350 | 58 | | 72 | 67 | 82 | 31 | 28 | 21 | 28 |
| 3. gi|15233068|ref|NP_191685.1| binding [*Arabidopsis thaliana*] AT3G61260 | 57 | 86 | | 80 | 74 | 29 | 28 | 21 | 29 |
| 4. gi|601843|gb|AAA57124.1| DNA-binding protein | 55 | 85 | 96 | | 70 | 30 | 22 | 19 | 28 |
| 5. gi|15229057|ref|NP_190463.1| DNA binding [*Arabidopsis thaliana*] AT3G48940 | 58 | 93 | 86 | 84 | | 28 | 24 | 20 | 24 |
| 6. gi|7267406|emb|CAB80876.1| hypothetical protein [*Arabidopsis thaliana*] AT4g00670 | 49 | 57 | 62 | 59 | 56 | | 21 | 18 | 13 |
| 7. gi|30697834|ref|NP_849866.1| DNA binding [*Arabidopsis thaliana*] AT1G69325 | 49 | 45 | 46 | 46 | 46 | 40 | | 16 | 27 |
| 8. gi|18408804|ref|NP_564900.1| DNA binding [*Arabidopsis thaliana*] AT1G67590 | 38 | 40 | 36 | 40 | 44 | 38 | 35 | | 12 |
| 9. gi|15240195|ref|NP_200936.1| DNA binding [*Arabidopsis thaliana*] AT5G61280 | 48 | 47 | 46 | 47 | 45 | 38 | 51 | 26 | |
| 10. gi|15227454|ref|NP_181718.1| DNA binding [*Arabidopsis thaliana*] AT2G41870 | 97 | 59 | 58 | 57 | 59 | 48 | 49 | 34 | 48 |
| 11. gi|15222980|ref|NP_172845.1| DNA binding [*Arabidopsis thaliana*] AT1G13920 | 51 | 43 | 44 | 46 | 43 | 37 | 64 | 30 | 55 |
| 12. gi|7270646|emb|CAB80363.1| hypothetical protein [*Arabidopsis thaliana*] AT4g36970 | 54 | 48 | 53 | 53 | 49 | 41 | 39 | 36 | 41 |
| 13. gi|42562741|ref|NP_175789.2| DNA binding [*Arabidopsis thaliana*] AT1G53860 | 48 | 50 | 52 | 50 | 51 | 39 | 39 | 34 | 39 |
| 14. gi|15220725|ref|NP_174322.1| DNA binding [*Arabidopsis thaliana*] AT1G30320 | 60 | 56 | 63 | 61 | 57 | 46 | 46 | 36 | 51 |
| 15. gi|42571771|ref|NP_973976.1| unknown protein [*Arabidopsis thaliana*] AT1G45207 | 46 | 43 | 47 | 46 | 43 | 39 | 44 | 36 | 39 |
| 16. gi|27764932|gb|AAO23587.1| At2g02170/F5O4.6 [*Arabidopsis thaliana*] | 57 | 60 | 58 | 58 | 60 | 45 | 47 | 30 | 54 |
| 17. gi|12325086|gb|AAG52495.1|AC018364_13 hypothetical protein; 34983-33172 [*Arabidopsis thaliana*] | 47 | 43 | 43 | 44 | 44 | 40 | 86 | 34 | 45 |

| | 10 | 11 | 12 | 13 | 14 | 15 | 16 | 17 |
|---|---|---|---|---|---|---|---|---|
| 1. gi|18410744|ref|NP_567050.1| DNA binding [*Arabidopsis thaliana*] AT3G57540 | 89 | 23 | 26 | 27 | 32 | 25 | 35 | 23 |
| 2. gi|21555669|gb|AAM63910.1| remorin [*Arabidopsis thaliana*] like At5g27350 | 34 | 27 | 23 | 25 | 35 | 25 | 41 | 25 |
| 3. gi|15233068|ref|NP_191685.1| binding [*Arabidopsis thaliana*] AT3G61260 | 35 | 28 | 28 | 27 | 35 | 24 | 38 | 23 |
| 4. gi|601843|gb|AAA57124.1| DNA-binding protein | 33 | 25 | 30 | 29 | 37 | 28 | 38 | 20 |
| 5. gi|15229057|ref|NP_190463.1| DNA binding [*Arabidopsis thaliana*] AT3G48940 | 33 | 26 | 24 | 27 | 37 | 22 | 39 | 20 |
| 6. gi|7267406|emb|CAB80876.1| hypothetical protein [*Arabidopsis thaliana*] AT4g00670 | 22 | 16 | 15 | 17 | 21 | 20 | 18 | 21 |
| 7. gi|30697834|ref|NP_849866.1| DNA binding [*Arabidopsis thaliana*] AT1G69325 | 28 | 43 | 18 | 17 | 24 | 20 | 26 | 79 |
| 8. gi|18408804|ref|NP_564900.1| DNA binding [*Arabidopsis thaliana*] AT1G67590 | 19 | 16 | 13 | 17 | 17 | 19 | 14 | 17 |
| 9. gi|15240195|ref|NP_200936.1| DNA binding [*Arabidopsis thaliana*] AT5G61280 | 26 | 37 | 21 | 17 | 20 | 24 | 27 | 26 |
| 10. gi|15227454|ref|NP_181718.1| DNA binding [*Arabidopsis thaliana*] AT2G41870 | | 25 | 28 | 29 | 37 | 25 | 38 | 41 |
| 11. gi|15222980|ref|NP_172845.1| DNA binding [*Arabidopsis thaliana*] AT1G13920 | 53 | | 18 | 23 | 27 | 18 | 29 | 17 |
| 12. gi|7270646|emb|CAB80363.1| hypothetical protein [*Arabidopsis thaliana*] AT4g36970 | 54 | 40 | | 32 | 26 | 35 | 33 | 20 |
| 13. gi|42562741|ref|NP_175789.2| DNA binding [*Arabidopsis thaliana*] AT1G53860 | 47 | 42 | 53 | | 33 | 29 | 36 | 21 |
| 14. gi|15220725|ref|NP_174322.1| DNA binding [*Arabidopsis thaliana*] AT1G30320 | 61 | 50 | 52 | 57 | | 29 | 52 | 23 |
| 15. gi|42571771|ref|NP_973976.1| unknown protein [*Arabidopsis thaliana*] AT1G45207 | 46 | 33 | 57 | 49 | 48 | | 29 | 23 |
| 16. gi|27764932|gb|AAO23587.1| At2g02170/F5O4.6 [*Arabidopsis thaliana*] | 57 | 51 | 58 | 62 | 75 | 56 | | 23 |
| 17. gi|12325086|gb|AAG52495.1|AC018364_13 hypothetical protein; 34983-33172 [*Arabidopsis thaliana*] | 47 | 59 | 38 | 40 | 46 | 43 | 45 | |

Example 34

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

Figure 20:
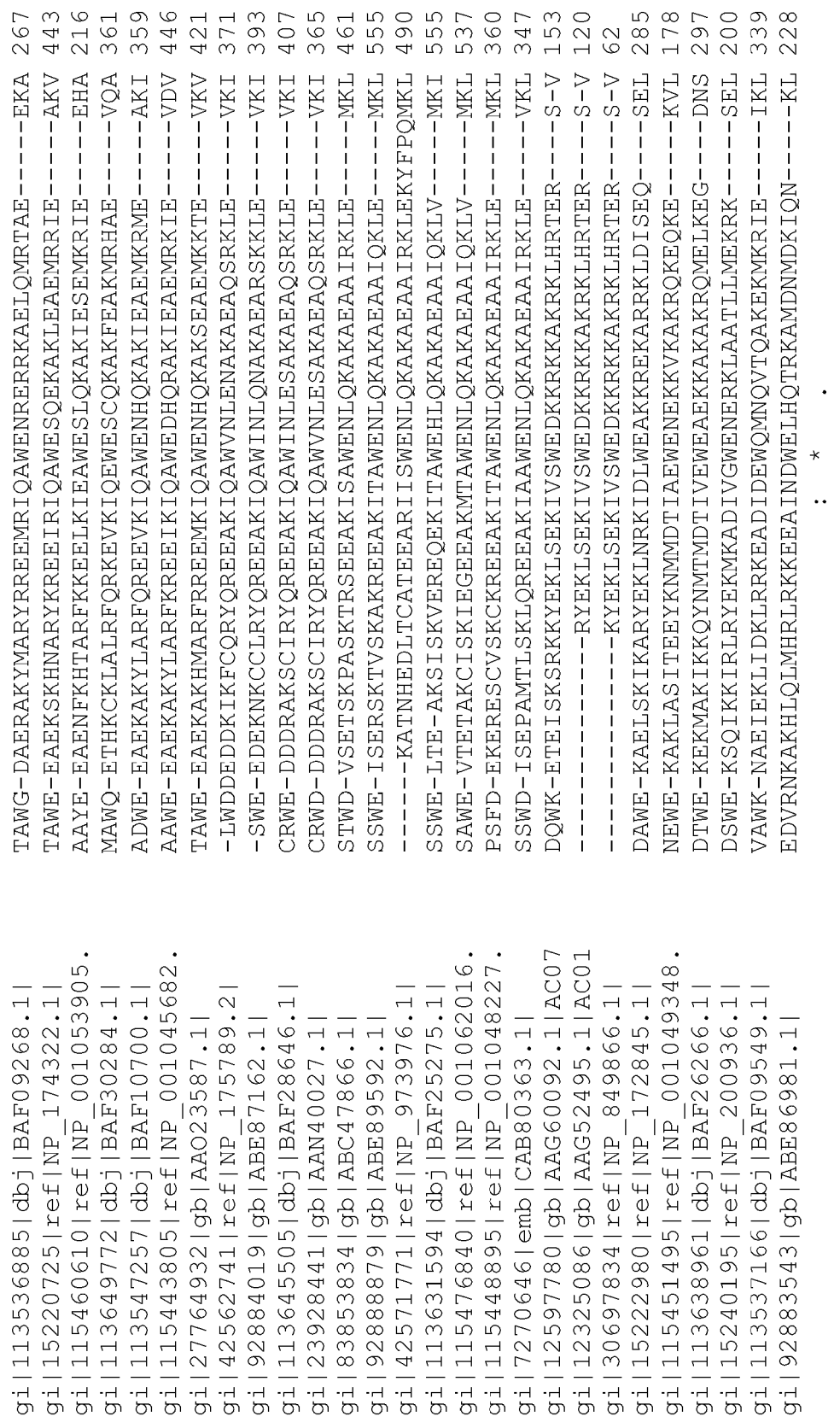
Figure 20:
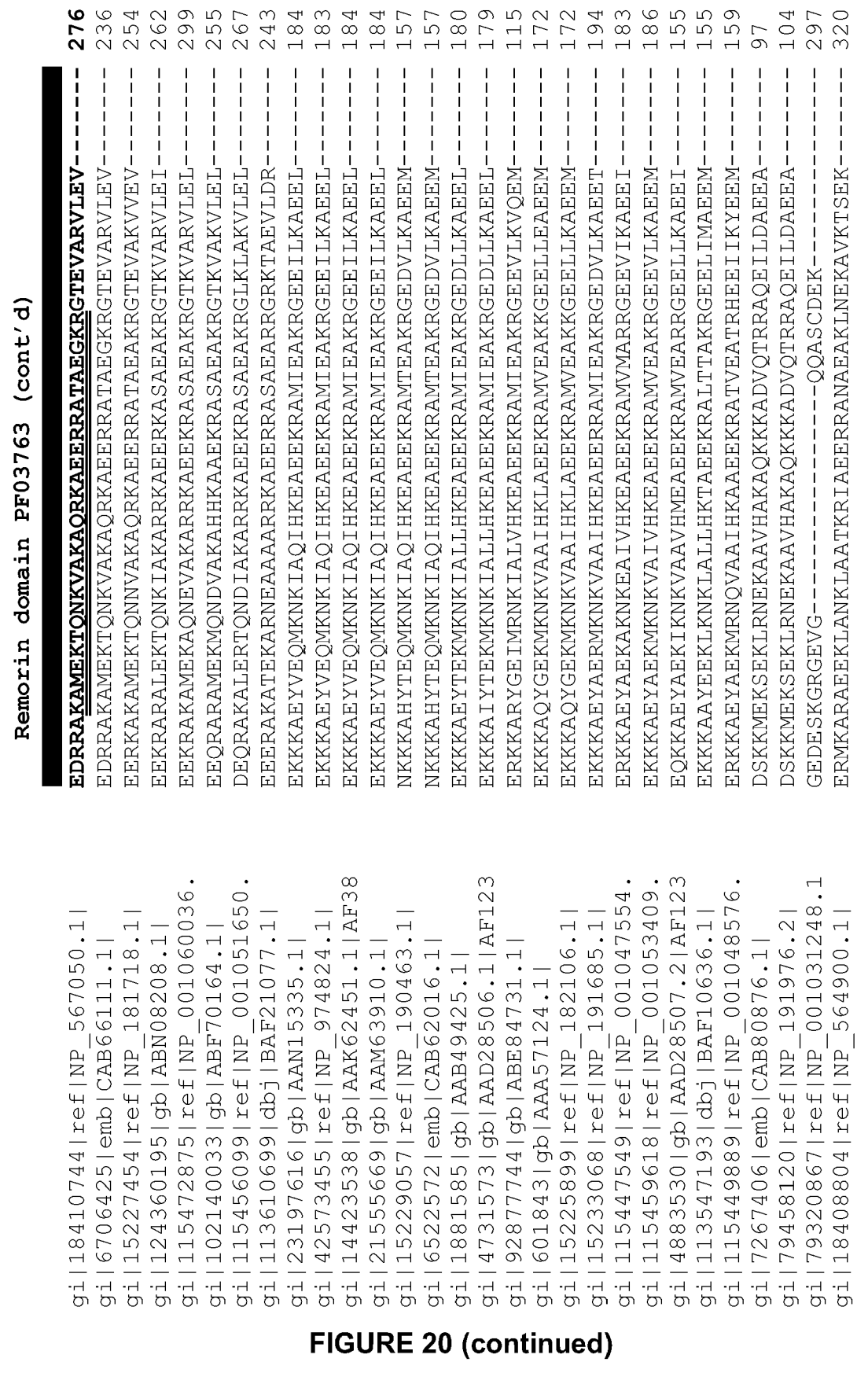

The results of the InterPro scan of the polypeptide sequence as represented by SEQ ID NO: 199 are presented in Table R and FIG. 20.

TABLE R

InterPro scan results (major accession numbers) of the polypeptide sequence as represented by SEQ ID NO: 199.

| Database | Accession number | Accession name | Amino acid coordinates on SEQ ID NO 199 |
|---|---|---|---|
| InterPro | IPR005516 | Remorin, C-terminal region | 180-291 |
| Pfam | PF03763 | Remorin_C | 180-291 |
| Prodom | PD350442 | Remorin_C | 180-291 |

Pfam is a large collection of multiple sequence alignments and hidden Markov models covering many common protein domains and families. Pfam is hosted at the Sanger Institute server in the United Kingdom.

Example 35

Prediction of Secondary Structure Features of the Polypeptide Sequences Useful in Performing the Methods of the Invention Coiled coils usually contain a repeated seven amino acid residue pattern called heptad repeats. Coiled coils are important to identify for protein-protein interactions, such as oligomerization, either of identical proteins, of proteins of the same family, or of unrelated proteins. A Remorin polypeptide can interact with itself, or with a Remorin orthologue or a paralogue. Recently much progress has been made in computational prediction of coiled coils from sequence data. Many algorithms well known to a person skilled in the art are available at the ExPASy Proteomics tools. One of them, COILS, is a program that compares a sequence to a database of known parallel two-stranded coiled-coils and derives a similarity score. By comparing this score to the distribution of scores in globular and coiled-coil proteins, the program then calculates the probability that the sequence will adopt a coiled-coil conformation.

The Remorin polypeptide as represented by SEQ ID NO: 199, has a C-terminal predicted coiled coil domain, with a high probability, in all three windows (14, 21 and 28) examined. In Table D, the residue coordinates, residues, the three windows and corresponding probability values are shown. In FIG. 2, is the graphical output of the COILS algorithm on the polypeptide as represented by SEQ ID NO: 2, where the predicted coiled coil is clearly visible in the C-terminal half of the polypeptide, in all three windows (as represented by the three lines).

TABLE S

Numerical output of the COILS algorithm on the polypeptide as represented by SEQ ID NO: 199. The residue coordinates (#), residues, the three windows and corresponding probability values are shown. Probabilities above 0.09 are shown in grey.

| # | Residue | Window = 14 | Prob | Window = 21 | Prob | Window = 28 | Prob |
|---|---|---|---|---|---|---|---|
| 213 | G | c | 0.003 | C | 0.014 | b | 0.004 |
| 214 | W | d | 0.002 | C | 0.069 | c | 0.013 |
| 215 | L | d | 0.014 | D | 0.821 | d | 0.626 |
| 216 | N | e | 0.014 | E | 0.821 | e | 0.626 |
| 217 | E | f | 0.014 | F | 0.821 | f | 0.626 |
| 218 | Q | g | 0.014 | G | 0.821 | g | 0.626 |
| 219 | V | a | 0.014 | A | 0.821 | a | 0.626 |
| 220 | H | b | 0.014 | B | 0.821 | b | 0.626 |
| 221 | R | c | 0.066 | C | 0.821 | c | 0.626 |
| 222 | A | d | 0.066 | D | 0.821 | d | 0.626 |
| 223 | N | e | 0.066 | E | 0.821 | e | 0.626 |
| 224 | S | f | 0.066 | F | 0.821 | f | 0.626 |
| 225 | W | g | 0.066 | G | 0.821 | g | 0.626 |
| 226 | M | a | 0.642 | A | 0.821 | a | 0.626 |
| 227 | K | b | 0.642 | B | 0.821 | b | 0.626 |
| 228 | K | c | 0.642 | C | 0.821 | c | 0.626 |
| 229 | I | d | 0.642 | D | 0.821 | d | 0.626 |
| 230 | E | e | 0.642 | E | 0.821 | d | 0.746 |
| 231 | R | f | 0.642 | F | 0.821 | b | 0.819 |
| 232 | K | g | 0.642 | G | 0.821 | c | 0.819 |
| 233 | L | a | 0.642 | A | 0.821 | d | 0.819 |
| 234 | E | b | 0.642 | B | 0.821 | e | 0.819 |
| 235 | D | c | 0.642 | C | 0.821 | f | 0.819 |
| 236 | R | d | 0.642 | D | 0.789 | f | 0.889 |
| 237 | R | e | 0.642 | D | 0.871 | g | 0.889 |
| 238 | A | f | 0.642 | E | 0.871 | a | 0.889 |
| 239 | K | f | 0.908 | F | 0.976 | f | 0.967 |
| 240 | A | g | 0.930 | G | 0.976 | g | 0.967 |
| 241 | M | a | 0.982 | A | 0.976 | a | 0.967 |
| 242 | E | b | 0.982 | B | 0.976 | b | 0.967 |
| 243 | K | c | 0.982 | C | 0.976 | c | 0.967 |
| 244 | T | d | 0.982 | D | 0.976 | d | 0.967 |
| 245 | Q | e | 0.982 | E | 0.976 | e | 0.967 |
| 246 | N | f | 0.982 | F | 0.976 | f | 0.967 |
| 247 | K | g | 0.982 | G | 0.976 | g | 0.967 |
| 248 | V | a | 0.982 | A | 0.976 | a | 0.967 |
| 249 | A | b | 0.982 | B | 0.976 | b | 0.967 |
| 250 | K | c | 0.982 | C | 0.976 | c | 0.967 |
| 251 | A | d | 0.982 | D | 0.976 | d | 0.967 |
| 252 | Q | e | 0.982 | E | 0.976 | e | 0.967 |
| 253 | R | f | 0.982 | F | 0.976 | f | 0.967 |
| 254 | K | g | 0.982 | G | 0.976 | g | 0.967 |
| 255 | A | a | 0.981 | A | 0.976 | a | 0.967 |
| 256 | E | b | 0.981 | B | 0.976 | b | 0.967 |
| 257 | E | c | 0.981 | C | 0.976 | c | 0.967 |
| 258 | R | d | 0.727 | D | 0.976 | d | 0.967 |
| 259 | R | e | 0.578 | E | 0.976 | e | 0.967 |
| 260 | A | b | 0.577 | F | 0.964 | f | 0.967 |
| 261 | T | c | 0.577 | G | 0.958 | g | 0.967 |
| 262 | A | d | 0.577 | A | 0.913 | a | 0.967 |
| 263 | E | e | 0.577 | B | 0.913 | b | 0.967 |
| 264 | G | f | 0.577 | C | 0.585 | c | 0.967 |
| 265 | K | g | 0.577 | D | 0.550 | d | 0.967 |
| 266 | R | a | 0.577 | E | 0.407 | e | 0.967 |
| 267 | G | b | 0.092 | F | 0.064 | f | 0.769 |
| 268 | T | c | 0.029 | G | 0.024 | g | 0.741 |

TABLE S-continued

Numerical output of the COILS algorithm on the polypeptide as represented by SEQ ID NO: 199. The residue coordinates (#), residues, the three windows and corresponding probability values are shown. Probabilities above 0.09 are shown in grey.

| # | Residue | Window = 14 | Prob | Window = 21 | Prob | Window = 28 | |
|---|---------|-------------|-------|-------------|-------|-------------|-------|
| 269 | E | d | 0.010 | D | 0.023 | a | 0.159 |
| 270 | V | a | 0.007 | E | 0.023 | b | 0.017 |
| 271 | A | b | 0.007 | F | 0.023 | c | 0.009 |
| 272 | R | c | 0.007 | G | 0.023 | g | 0.007 |
| 273 | V | d | 0.007 | A | 0.023 | a | 0.007 |
| 274 | L | e | 0.007 | B | 0.007 | b | 0.007 |

Other important secondary structures can be predicted using algorithms requiring the sequence information as listed in SEQ ID NO: 199. Many useful algorithms are regrouped at the ExPaSy site, hosted by the Swiss Bioinformatics Institute. For example, Jpred is a web server that takes a protein sequence or multiple alignment of protein sequences, and from these predicts secondary structure using a neural network called Jnet. The prediction is the definition of each residue into either alpha helix (H), beta sheet (E) or random coil (C) secondary structures. Below is the output of the prediction program, for the Remorin polypeptide as represented by SEQ ID NO: 199:

```
MLTLYGQERSPENSTTSTTDASDRRDETPSSEIVVRDIHAMTTTTELTRPQQRGSGGGYLSP
-------------------------------EEEEEEEE----------------------

SRSIAFSDGTTSSGENFTTVSREFNALVIAGSSMDNNSNGTNQSGGHRDVIRDERNELTRIG
-----------------EEHHHHHHHHHH----------------EEEEEE----------

ENDDVGDHGQVPEEDSNPWAIVPDDYNNRDGSENNIVLASSGGQNRMVTTASVQRVKREEVE
-------------------EEE-------------------------EEEEEEEHHHHHH

AKITAWQTAKVAKINNRFKRQDAVINGWLNEQVHRANSWMKKIERKLEDRRAKAMEKTQNKV
HHHHHHHHHHHHHH-------EEE----HHHHHHHHHHHHHHHHHHHHHHHHHHHHHHHHH

AKAQRKAEERRATAEGKRGTEVARVLEVANLMRAVGRPPAKRSFFSLS
HHHHHHHHHHHHHHHHH--HHHHHHHHHHHHHHH---------EE---
```

Example 36

Amino Acid Composition of the Polypeptide Sequence as Represented by SEQ ID NO: 199

Primary amino acid composition (in %) to determine if a polypeptide domain is rich in specific amino acids may be calculated using software programs, in particular the ProtParam tool, from the ExPASy server (Gasteiger et al. (2003) ExPASy: the proteomics server for in-depth protein knowledge and analysis. Nucleic Acids Res 31:3784-3788). The composition of the protein of interest may then be compared to the average amino acid composition (in %) in the UniProtKB/Swiss-Prot Protein Sequence data bank (release 52.0 of 6 Mar. 2007, containing 260175 sequence entries, comprising 95002661 amino acids abstracted from 152564 references).

The polypeptide as represented by SEQ ID NO: 199, the Remorin domain of SEQ ID NO: 199, and the N-terminal domain of SEQ ID NO: 199, have been analysed for their amino acid composition. The results are shown in Tables T and U below.

TABLE T

Amino acid composition of the polypeptide as represented by SEQ ID NO: 199, of the C-terminal Remorin domain of SEQ ID NO: 199, and of the N-terminal domain of SEQ ID NO: 199 (amino acid residues upstream of the C-terminal Remorin domain, from N- to C-terminus), compared to the average amino acid composition (in %) in the UniProtKB/Swiss-Prot Protein Sequence data bank (release 52.0 of 6 Mar. 2007.

| Residue | | Full length polypeptide (296 amino acids in total) | | Remorin domain (180-290) | | N-terminal domain (1-179) | | Swiss-Prot 52.0 |
|---|---|---|---|---|---|---|---|---|
| | | Count | % | Count | % | Count | % | % |
| Ala | (A) | 25 | 8.4 | 17 | 15.3 | 8 | 4.5 | 7.88 |
| Arg | (R) | 30 | 10.1 | 15 | 13.5 | 15 | 8.4 | 5.42 |
| Asn | (N) | 22 | 7.4 | 7 | 6.3 | 15 | 8.4 | 4.13 |
| Asp | (D) | 17 | 5.7 | 2 | 1.8 | 15 | 8.4 | 5.33 |
| Cys | (C) | 0 | 0.0 | 0 | 0.0 | 0 | 0.0 | 1.5 |
| Gln | (Q) | 12 | 4.1 | 5 | 4.5 | 7 | 3.9 | 3.96 |
| Glu | (E) | 25 | 8.4 | 12 | 10.8 | 13 | 7.3 | 6.66 |
| Gly | (G) | 21 | 7.1 | 4 | 3.6 | 7 | 9.5 | 6.96 |
| His | (H) | 4 | 1.4 | 1 | 0.9 | 3 | 1.7 | 2.29 |
| Ile | (I) | 12 | 4.1 | 4 | 3.6 | 8 | 4.5 | 5.91 |
| Leu | (L) | 12 | 4.1 | 4 | 3.6 | 7 | 3.9 | 9.65 |
| Lys | (K) | 15 | 5.1 | 15 | 13.5 | 0 | 0.0 | 5.92 |
| Met | (M) | 7 | 2.4 | 3 | 2.7 | 4 | 2.2 | 2.39 |
| Phe | (F) | 6 | 2.0 | 1 | 0.9 | 3 | 1.7 | 3.95 |
| Pro | (P) | 9 | 3.0 | 2 | 1.8 | 7 | 3.9 | 4.82 |
| Ser | (S) | 27 | 9.1 | 1 | 0.9 | 23 | 12.8 | 6.84 |
| Thr | (T) | 24 | 8.1 | 5 | 4.5 | 19 | 10.6 | 5.40 |
| Trp | (W) | 4 | 1.4 | 3 | 2.7 | 1 | 0.6 | 1.13 |
| Tyr | (Y) | 3 | 1.0 | 0 | 0.0 | 3 | 1.7 | 3.01 |
| Val | (V) | 21 | 7.1 | 10 | 9.0 | 11 | 3.1 | 6.73 |

TABLE U

Number of positively and negatively charged residues of the polypeptide as represented by SEQ ID NO: 199, of the Remorin domain of SEQ ID NO: 199, and of the N-terminal domain of SEQ ID NO: 199.

| | SEQ ID NO: 199 | Remorin domain (180-290) | N-terminal domain (1-179) | Swiss-Prot 52.0 in percentage |
|---|---|---|---|---|
| Total number of negatively charged residues (Asp + Glu): | 42 | 14 | 28 | 12% |
| Total number of positively charged residues (Arg + Lys): | 45 | 30 | 15 | 11.3% |
| Percentage of charged amino acids in total: | 29% | 40% | 24% | 23.33% |

The Remorin domain is enriched in charged amino acids, particularly in Lys, Arg and Glu.

Example 37

Prediction of Serine/Threonine Protein Kinase Phosphorylation Sites Comprised in the Polypeptide Useful in Performing the Methods of the Invention Phosphorylation states of a polypeptide are usually related to an activation or inactivation or to intermediate levels of activation/inactivation of the polypeptide. OGA and or PGA-enhanced phosphorylation of Remorin is at one or more threonine residue(s), as the product of a serine/threonine protein kinase. While serine/threonine kinases all phosphorylate serine or threonine residues in their substrates, they select specific residues to phosphorylate on the basis of residues that flank the phosphoacceptor site, which together comprise the consensus sequence. As well known in the art, several algorithms have been developed to predict such phosphorylation sites, based on a given polypeptide sequence. The NetPhos 2.0 server, hosted at the Technical University of Denmark, produces neural network predictions for serine, threonine and tyrosine phosphorylation sites in eukaryotic proteins.

NetPhos 2.0 Server—Prediction Results

```
NetPhos 2.0 Server - prediction results (SEQ ID NO: 199)

MLTLYGQERSPENSTTSTTDASDRRDETPSSEIVVRDIHAMTTTTELTRPQQRGSGGGYLSPSRSIAFSDGTTSSGENFT    80
.........S...S..ST...S.....T.SS..........TT..........S.....S......S....SS.....    80

TVSREFNALVIAGSSMDNNSNGTNQSGGHRDVIRDERNELTRIGENDDVGDHGQVPEEDSNPWAIVPDDYNNRDGSENNI   160
...............................................................................S....  160

VLASSGGQNRMVTTASVQRVKREEVEAKITAWQTAKVAKINNRFKRQDAVINGWLNEQVHRANSWMKKIERKLEDRRAKA   240
....S.......T....................T............................S................   240

MEKTQNKVAKAQRKAEERRATAEGKRGTEVARVLEVANLMRAVGRPPAKRSFFSLS                            320
....................T......T...........................                            320

Phosphorylation sites predicted: Ser: 14Thr: 8
```

| | Serine predictions | | | |
|---|---|---|---|---|
| Name | Pos | Context | Score | Pred |
| SEQ ID NO: 199 | 10 | GQERSPENS | 0.986 | *S* |
| SEQ ID NO: 199 | 14 | SPENSTTST | 0.974 | *S* |
| SEQ ID NO: 199 | 17 | NSTTSTTDA | 0.997 | *S* |
| SEQ ID NO: 199 | 22 | TTDASDRRD | 0.995 | *S* |
| SEQ ID NO: 199 | 30 | DETPSSEIV | 0.730 | *S* |
| SEQ ID NO: 199 | 31 | ETPSSEIVV | 0.677 | *S* |
| SEQ ID NO: 199 | 55 | QQRGSGGGY | 0.972 | *S* |
| SEQ ID NO: 199 | 61 | GGYLSPSRS | 0.979 | *S* |
| SEQ ID NO: 199 | 63 | YLSPSRSIA | 0.395 | . |
| SEQ ID NO: 199 | 65 | SPSRSIAFS | 0.415 | . |
| SEQ ID NO: 199 | 69 | SIAFSDGTT | 0.942 | *S* |
| SEQ ID NO: 199 | 74 | DGTTSSGEN | 0.990 | *S* |
| SEQ ID NO: 199 | 75 | GTTSSGENF | 0.845 | *S* |
| SEQ ID NO: 199 | 83 | FTTVSREFN | 0.237 | . |
| SEQ ID NO: 199 | 94 | VIAGSSMDN | 0.417 | . |
| SEQ ID NO: 199 | 95 | IAGSSMDNN | 0.311 | . |
| SEQ ID NO: 199 | 100 | MDNNSNGTN | 0.026 | . |

| NetPhos 2.0 Server - prediction results (SEQ ID NO: 199) | | | | |
|---|---|---|---|---|
| SEQ ID NO: 199 | 106 | GTNQSGGHR | 0.014 | . |
| SEQ ID NO: 199 | 140 | PEEDSNPWA | 0.023 | . |
| SEQ ID NO: 199 | 156 | NRDGSENNI | 0.951 | *S* |
| SEQ ID NO: 199 | 164 | IVLASSGGQ | 0.014 | . |
| SEQ ID NO: 199 | 165 | VLASSGGQN | 0.960 | *S* |
| SEQ ID NO: 199 | 176 | VTTASVQRV | 0.164 | . |
| SEQ ID NO: 199 | 224 | HRANSWMKK | 0.895 | *S* |
| SEQ ID NO: 199 | 291 | PAKRSFFSL | 0.039 | . |
| SEQ ID NO: 199 | 294 | RSFFSLS-- | 0.121 | . |
| SEQ ID NO: 199 | 296 | FFSLS---- | 0.019 | . |
| Threonine predictions | | | | |
| Name | Pos | Context | Score | Pred |
| SEQ ID NO: 199 | 3 | --MLTLYGQ | 0.176 | . |
| SEQ ID NO: 199 | 15 | PENSTTSTT | 0.122 | . |
| SEQ ID NO: 199 | 16 | ENSTTSTTD | 0.059 | . |
| SEQ ID NO: 199 | 18 | STTSTTDAS | 0.526 | *T* |
| SEQ ID NO: 199 | 19 | TTSTTDASD | 0.038 | . |
| SEQ ID NO: 199 | 28 | RRDETPSSE | 0.983 | *T* |
| SEQ ID NO: 199 | 42 | IHAMTTTTE | 0.165 | . |
| SEQ ID NO: 199 | 43 | HAMTTTTEL | 0.918 | *T* |
| SEQ ID NO: 199 | 44 | AMTTTTELT | 0.673 | *T* |
| SEQ ID NO: 199 | 45 | MTTTTELTR | 0.069 | . |
| SEQ ID NO: 199 | 48 | TTELTRPQQ | 0.061 | . |
| SEQ ID NO: 199 | 72 | FSDGTTSSG | 0.118 | . |
| SEQ ID NO: 199 | 73 | SDGTTSSGE | 0.491 | . |
| SEQ ID NO: 199 | 80 | GENFTTVSR | 0.055 | . |
| SEQ ID NO: 199 | 81 | ENFTTVSRE | 0.331 | . |
| SEQ ID NO: 199 | 103 | NSNGTNQSG | 0.010 | . |
| SEQ ID NO: 199 | 121 | RNELTRIGE | 0.280 | . |
| SEQ ID NO: 199 | 173 | NRMVTTASV | 0.528 | *T* |
| SEQ ID NO: 199 | 174 | RMVTTASVQ | 0.484 | . |
| SEQ ID NO: 199 | 190 | EAKITAWQT | 0.138 | . |
| SEQ ID NO: 199 | 194 | TAWQTAKVA | 0.936 | *T* |
| SEQ ID NO: 199 | 244 | AMEKTQNKV | 0.497 | . |
| SEQ ID NO: 199 | 261 | ERRATAEGK | 0.951 | *T* |
| SEQ ID NO: 199 | 268 | GKRGTEVAR | 0.769 | *T* |

Example 38

Identification of Predicted Sites for Modification of the Polypeptide Sequence as Represented by SEQ ID NO: 199

Post-translational modifications of polypeptides, usually at specific sites, are generally important but are not necessarily an absolute requirement for the biological function of those polypeptides. The identification of predicted post-translational modifications sites can contribute however, to a better understanding of the involvement of the polypeptide of interest in the biology of the cell.

38.1 Identification of SUMO Motifs

Sumoylation is a protein post-translational modification analogous to ubiquitin, reversible covalent attachment of SUMO (small ubiquitin-like modifier) to lysine residues in substrate proteins alters the properties of the proteins to which SUMO conjugates. However, in contrast to ubiquitin, SUMO conjugation does not typically lead to degradation of the substrate; rather, sumoylation orchestrates a diverse array of effects on many different biological processes, including protein localization and stability, transcriptional activities, nucleo-cytoplasmic signaling and transport, and genomic replication, as well as the regulation of gene expression and viral reproduction.

The putative sumoylation sites may be predicted using special algorithms such as SUMOplot at the ExPASy server. Most SUMO-modified proteins contain the tetrapeptide motif B-K-x-D/E where B is a hydrophobic residue, K is the lysine conjugated to SUMO, x is any amino acid (aa), D or E is an acidic residue.

When the Remorin polypeptide of SEQ ID NO: 199 is submitted to the SUMOplot algorithm, a sumoylation site is predicted at Lys (or K) coordinate 181, as shown below.

When the Remorin polypeptide of SEQ ID NO: 199 is submitted to the SUMOplot algorithm, a sumoylation site is predicted at Lys (or K) coordinate 181, as shown below.

| No. | SEQ ID NO: | Pos. | Group | Score |
|---|---|---|---|---|
| 1 | 199 | K181 | ASVQR VKRE EVEAK | 0.93 |

```
  1 MLTLYGQERS PENSTTSTTD ASDRRDETPS SEIVVRDIHA MTTTTELTRP

51 QQRGSGGGYL SPSRSIAFSD GTTSSGENFT TVSREFNALV IAGSSMDNNS

101 NGTNQSGGHR DVIRDERNEL TRIGENDDVG DHGQVPEEDS NPWAIVPDDY

151 NNRDGSENNI VLASSGGQNR MVTTASVQRV KREEVEAKIT AWQTAKVAKI

201 NNRFKRQDAV INGWLNEQVH RANSWMKKIE RKLEDRRAKA MEKTQNKVAK

251 AQRKAEERRA TAEGKRGTEV ARVLEVANLM RAVGRPPAKR SFFSLS
    (SEQ ID NO: 199)
```

38.2 Identification of PEST Motifs

PEST sequences are found in many rapidly degraded proteins. These sequences have been suggested to serve as signals for proteolytic degradation. The algorithm, PESTFind (hosted at EmbNet), searches for hydrophilic regions of 12 or greater amino acids that contain at least one P (proline), one E (glutamic acid) or D (aspartic acid), and one S (serine) or T (threonine), flanked by K (lysine), R (arginine), or H (histidine) residues. The algorithm assigns a score to each possible PEST sequence found. The score ranges from −50 to +50, with a score above zero denoting a possible PEST region while a value greater than +5 being of particular interest. Using the algorithm, a predicted PEST motif is found at amino acid coordinates 9 to 24, with a hydrophobicity index of 28.64. The low hydrophobicity suggests the region may be surface accessible to proteases or for protein-protein interaction with other proteins such as molecular chaperones, trafficking proteins, or components of proteolytic systems.

```
MLTLYGQERSPENSTTSTTDASDRRDETPSSEIVVRDIHAMTTTTELTRP         50
        ++++++++++++++++ -----------

QQRGSGGGYLSPSRSIAFSDGTTSSGENFTTVSREFNALVIAGSSMDNNS        100

NGTNQSGGHRDVIRDERNELTRIGENDDVGDHGQVPEEDSNPWAIVPDDY        150
                                 -------------------

NNRDGSENNIVLASSGGQNRMVTTASVQRVKREEVEAKITAWQTAKVAKI        200
--
```

```
                                -continued
NNRFKRQDAVINGWLNEQVHRANSWMKKIERKLEDRRAKAMEKTQNKVAK         250

AQRKAEERRATAEGKRGTEVARVLEVANLMRAVGRPPAKRSFFSLS             296
   (SEQ ID NO: 199)

++++++ possible PEST sequence
------ poor PEST sequence
POTENTIAL PEST SEQUENCES:
9 RSPENSTTSTTDASDR 24 (found within SEQ ID NO: 199)

mole fraction of PEDST:     63.24
hydrophobicity index:       28.64
PEST-FIND score:           +20.46
```

Example 39

Cloning of Nucleic Acid Sequence as Represented by SEQ ID NO: 198

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* Remorin gene was amplified by PCR using as template an *Arabidopsis* cDNA bank synthesized from mRNA extracted from mixed plant tissues. Primer prm09186 (SEQ ID NO: 327; sense:

5'-GGGGACAAGTTTGTACAAAAAAGCAGGCTTAAACAATGTTGACTTTG

TACGGTCAA-3')

and primer prm09187 SEQ ID NO: 328; reverse, complementary:

5'-GGGGACCACTTTGTACAAGAAAGCTGGGTAGCTTAGCTAGGAAAGAG

AGAA-3'), which include the AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Example 40

Expression Vector Construction Using the Nucleic Acid Sequence as Represented by SEQ ID NO: 198

The entry clone comprising SEQ ID NO: 198 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 329) for constitutive expression was located upstream of this Gateway cassette. In a second expression vector, another promoter, high mobility group B (HMGB; SEQ ID NO: 330) also for constitutive expression, was located upstream of the Gateway cassette.

Figure 21:
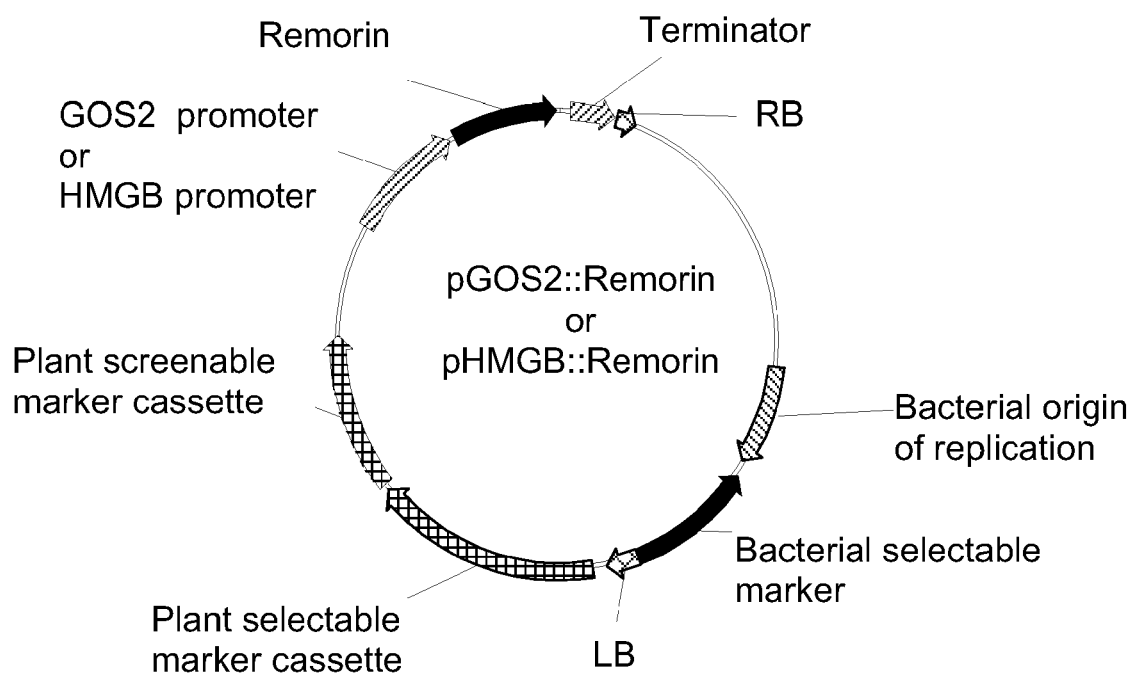
FIG. 21 shows the binary vector for increased expression in *Oryza sativa* of an *Arabidopsis thaliana* nucleic acid sequence encoding a Remorin polypeptide under the control of a constitutive promoter, either GOS2 or HMGB.
Figure 23:
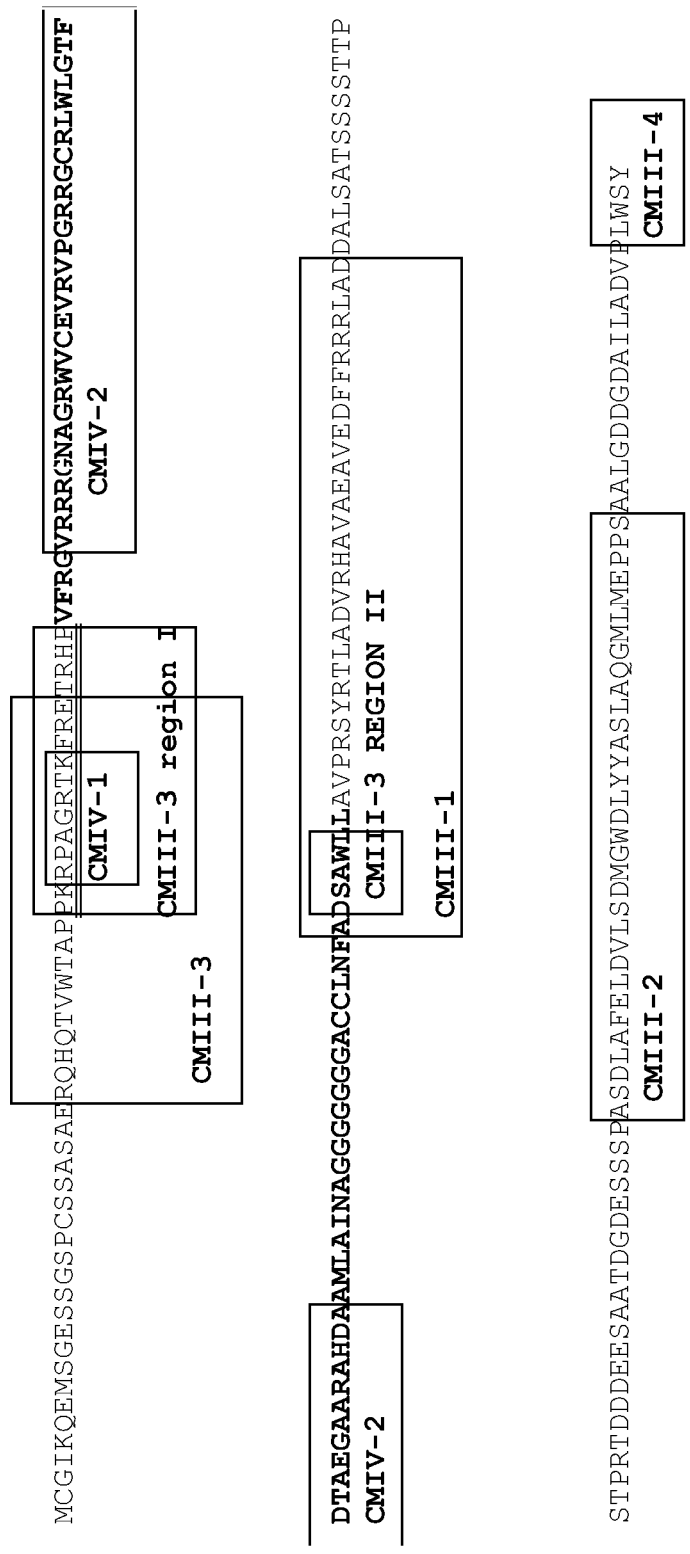
FIG. 23 is a representation of a full-length sequence of OsDREB1A (SEQ ID NO:336) protein. The position of the conserved motifs CMIII-1 to CMIII-4 and CMIV-1 and CMIV-2 is indicated. A putative localization signal is double underlined. The region corresponding to the AP2 domain is labeled in bold.
Figure 25:
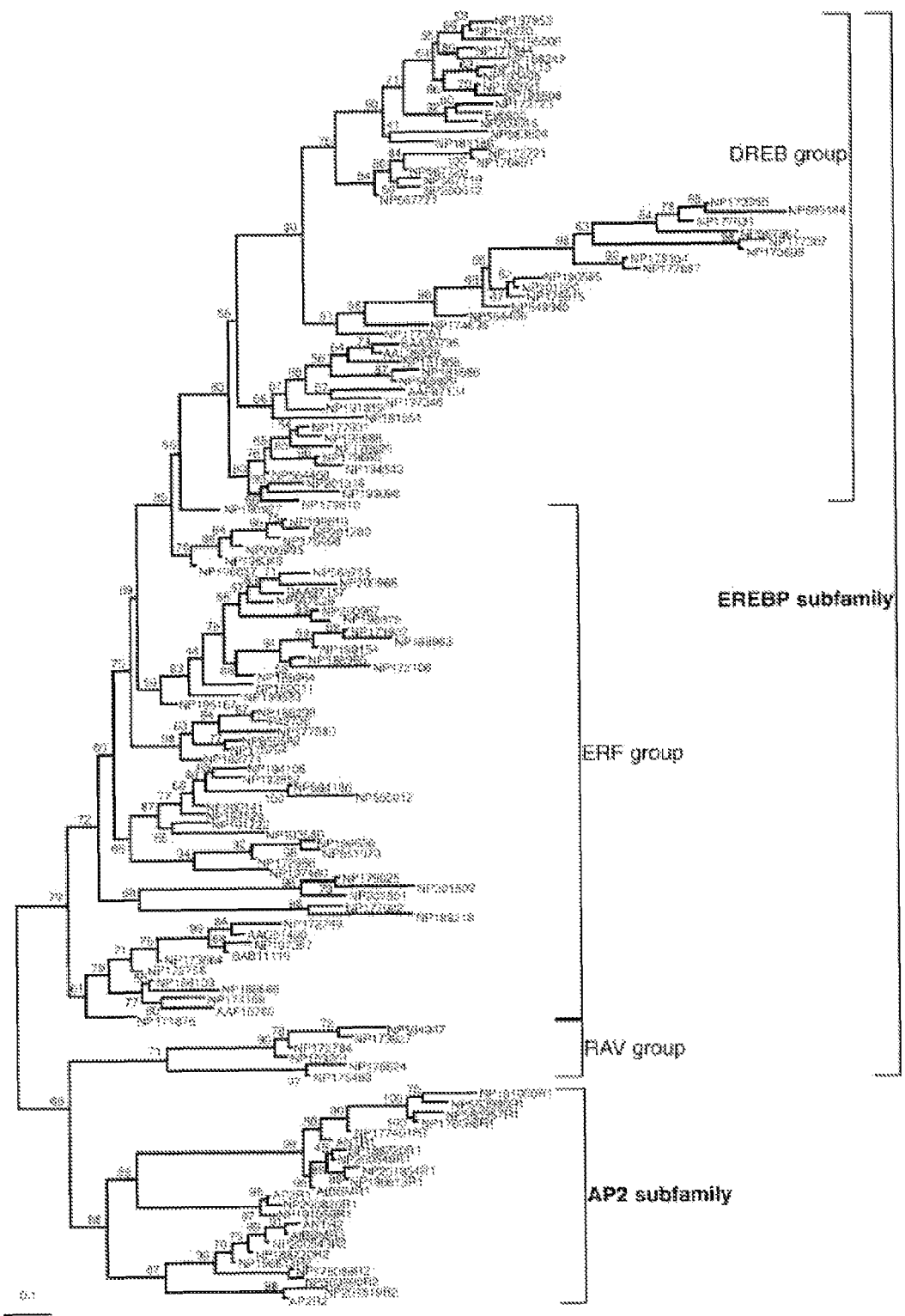
FIG. 25 shows an unrooted maximum-likelihood tree of the AP2/EREBP multigene family phylogenetic tree as published by Shigyo et al. 2006. The different subfamilies and groups, in which the AP2 transcription factors are classified, including the DREB GROUP, are indicated.

After the LR recombination step, the resulting expression vectors pGOS2::Remorin and pHMGB::Remorin (FIG. 21) were independently transformed into *Agrobacterium* strain LBA4044 according to methods well known in the art.

Example 41

Plant Transformation

Rice Transformation

The *Agrobacterium* containing the expression vectors were used independently to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing each individual expression vector was used independently for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for each construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Example 42

Phenotypic Evaluation Procedure 42.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

From the stage of sowing until the stage of maturity the plants were passed several times through a digital imaging cabinet. At each time point digital images (2048×1536 pixels, 16 million colours) were taken of each plant from at least 6 different angles.

Nitrogen Use Efficiency Screen

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

42.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

42.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed weight per plant was measured by weighing all filled husks harvested from one plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed weight per plant and the above ground area (mm$^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 43

Results of the Phenotypic Evaluation of the Transgenic Rice Plants

The results of the evaluation of transgenic rice plants expressing the Remorin nucleic acid sequence as represented by SEQ ID NO: 199, under the control of the GOS2 promoter for constitutive expression, are presented below.

There was a significant increase in the seed fill rate, in the total seed yield per plant, in the total number of filled seeds, in the total number of seeds, in the Thousand Kernel Weight (TKW), and in the harvest index of the transgenic plants compared to corresponding nullizygotes (controls), as shown in Table V.

TABLE V

Results of the evaluation of transgenic rice plants expressing the Remorin nucleic acid sequence as represented by SEQ ID NO: 199, under the control of the GOS2 promoter.

| | Average % increase in T1 generation |
|---|---|
| Seed fill rate | 10% |
| Total seed yield per plant | 19% |
| Total number of filled seeds | 15% |
| Total number of seeds | 5% |
| TKW | 3% |
| Harvest index | 21% |

The results of the evaluation of transgenic rice plants expressing the Remorin nucleic acid sequence as represented by SEQ ID NO: 199, under the control of the HMGB promoter for constitutive expression, are presented below.

There was a significant increase in the seed fill rate, in the total seed yield per plant, in the total number of filled seeds, in the total number of seeds, in the Thousand Kernel Weight (TKW), and in the harvest index of the transgenic plants compared to corresponding nullizygotes (controls), as shown in Table W.

TABLE W

Results of the evaluation of transgenic rice plants expressing the Remorin nucleic acid sequence as represented by SEQ ID NO: 199, under the control of the HMGB promoter.

| | Average % increase in T1 generation |
|---|---|
| Seed fill rate | 6% |
| Total seed yield per plant | 14% |
| Total number of filled seeds | 14% |
| Total number of seeds | 7% |
| TKW | 1% |
| Harvest index | 12% |

Example 44

Results of the Phenotypic Evaluation of the Transgenic Rice Plants

Nucleic acid sequences encoding Remorin polypeptides as represented by SEQ ID NO: 203, SEQ ID NO: 217, SEQ ID NO: 227, SEQ ID NO: 229, SEQ ID NO: 233, and SEQ ID NO: 241, were placed under the control of a constitutive promoter, and transformed into rice. Enhanced yield-related traits were observed in the transgenic rice plants relative to control plants, as shown in the Table X below.

TABLE X

Summary of the enhanced yield-related traits observed in transgenics plants expressing a nucleic acid sequence encoding a Remorin polypeptide under the control of a constitutive promoter.

| | Enhanced yield-related traits | | | | | |
|---|---|---|---|---|---|---|
| Remorin polypeptide | Above-ground biomass | Seed fill rate | Total seed yield per plant | Total number of filled seeds | TKW | Harvest index |
| SEQ ID NO: 217 | ✓ | ✓ | ✓ | ✓ | | ✓ |
| SEQ ID NO: 203 | | | ✓ | ✓ | ✓ | ✓ |
| SEQ ID NO: 233 | | | | | ✓ | |
| SEQ ID NO: 229 | | ✓ | ✓ | ✓ | | ✓ |
| SEQ ID NO: 227 | | ✓ | ✓ | ✓ | | ✓ |
| SEQ ID NO: 241 | | ✓ | | | ✓ | ✓ |

Transgenic rice plants expressing the Remorin nucleic acid sequence as represented by SEQ ID NO: 233, under the control of the GOS2 promoter for constitutive expression, and grown on nutrient solution with reduced nitrogen content showed a significant increase in Thousand Kernel Weight (overall increase more than 5%, p-value of 0.0000). Furthermore, in several events an increase was observed for one or more of total number of seeds, number of filled seeds, total weight of seeds, root/shoot index and early vigour.

Example 45

Examples of Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 46

Identification of DREB Genes and DREB Proteins

Sequences (full length cDNA, ESTs or genomic) related to SEQ ID NO: 335 and/or protein sequences related to SEQ ID NO: 336 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. The polypeptide encoded by SEQ ID NO: 335 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. Examples of DREB proteins identified in Genbank (GenBank® is the NIH genetic sequence database available though the NCBI—National Centre for Biotechnology Information) are given in Table Y1. A preferred set of DREB genes and DREB proteins relevant to the invention is given in Table Y2. The GenBank accession number and the organism from which they originate are indicated.

TABLE Y1

DREB protein sequences originating from different organisms.

| GenBank Accession Number | Source organism |
|---|---|
| AAQ23983 | [Oryza sativa] |
| AAX28960 | [Sorghum bicolor] |
| AAX23703 | [Hordeum vulgare subsp. vulgare] |
| AAX28953 | [Hordeum vulgare subsp. vulgare] |
| ABK55358 | [Triticum aestivum] |
| CAG30550 | [Festuca arundinacea] |
| ABK55359 | [Triticum aestivum] |
| ABK55360 | [Triticum aestivum] |
| AAX57275 | [Lolium perenne] |
| ABK32848 | [Lolium perenne] |
| ABK32847 | [Lolium perenne] |
| NP_001115477639 | (japonica cultivar-group)] |
| BAD09739 | [Oryza sativa (japonica cultivar-group)] |
| BAD46703 | [Oryza sativa (japonica cultivar-group)] |
| EAZ09799 | [Oryza sativa (indica cultivar-group)] |
| AAY32555 | [Triticum monococcum] |
| AAY32550 | [Triticum monococcum] |
| ABK55363 | [Triticum aestivum] |
| AAX14175 | [Hordeum vulgare subsp. spontaneum] |
| AAX23694 | [Hordeum vulgare subsp. vulgare] |
| AAX14155 | [Hordeum vulgare subsp. spontaneum] |
| AAG59618 | [Hordeum vulgare subsp. vulgare] |
| AAX14163 | [Hordeum vulgare subsp. spontaneum] |
| AAX14173 | [Hordeum vulgare subsp. spontaneum] |
| AAX23693 | [Hordeum vulgare subsp. vulgare] |
| AAY32553 | [Triticum monococcum] |
| AAX14165 | [Hordeum vulgare subsp. spontaneum] |
| BAF36841 | [Lolium perenne] |
| ABK55361 | [Triticum aestivum] |
| ABK55362 | [Triticum aestivum] |
| AAX14170 | [Hordeum vulgare subsp. spontaneum] |
| AAX14169 | [Hordeum vulgare subsp. spontaneum] |
| AAX14171 | [Hordeum vulgare subsp. spontaneum] |
| CAJ21277 | [Avena sativa] |
| BAF36837 | [Lolium perenne] |
| BAF36838 | [Lolium perenne] |
| BAF36842 | [Lolium perenne] |
| AAX23712 | [Hordeum vulgare subsp. vulgare] |
| AAY32558 | [Triticum monococcum] |
| AAX23710 | [Hordeum vulgare subsp. vulgare] |
| AAX23713 | [Hordeum vulgare subsp. vulgare] |
| AAY32564 | [Triticum monococcum] |
| AAX23716 | [Hordeum vulgare subsp. vulgare] |
| AAX28956 | [Hordeum vulgare subsp. vulgare] |
| BAF36839 | [Lolium perenne] |
| AAY32554 | [Triticum monococcum] |
| ABK55364 | [Triticum aestivum] |
| Os09g0522000 | [Oryza sativa (japonica cultivar-group)] |
| BAF36840 | [Lolium perenne] |
| EAZ09798 | [Oryza sativa (indica cultivar-group)] |
| BAD09738 | [Oryza sativa (japonica cultivar-group)] |
| Os08g0545400 | [Oryza sativa (japonica cultivar-group)] |
| ABK55369 | [Triticum aestivum] |

TABLE Y1-continued

DREB protein sequences originating from different organisms.

| GenBank Accession Number | Source organism |
|---|---|
| ABK55370 | [Triticum aestivum] |
| EAZ07868 | [Oryza sativa (indica cultivar-group)] |
| AAY33832 | [Zea mays] |
| AAY32556 | [Triticum monococcum] |
| AAX23715 | [Hordeum vulgare subsp. vulgare] |
| AAN02488 | [Oryza sativa] |
| ABK55371 | [Triticum aestivum] |
| ABA01492 | [Hordeum vulgare subsp. vulgare] |
| AAP83888 | [Oryza sativa] |
| CAJ21278 | [Avena sativa] |
| ABK55367 | [Triticum aestivum] |
| ABK55368 | [Triticum aestivum] |
| ABK55365 | [Triticum aestivum] |
| ABK55366 | [Triticum aestivum] |
| ABA01491 | [Hordeum vulgare subsp. vulgare] |
| AAQ98965 | [Schedonorus arundinaceus] |
| ABA25904 | [Hordeum vulgare subsp. vulgare] |
| AAY32557 | [Triticum monococcum] |
| BAD66926 | [Triticum aestivum] |
| ABK55375 | [Triticum aestivum] |
| BAF36843 | [Lolium perenne] |
| CAG23919 | [Festuca arundinacea] |
| ABK55377 | [Triticum aestivum] |
| ABK55376 | [Triticum aestivum] |
| BAD66925 | [Triticum aestivum] |
| AAL35759 | [Secale cereale] |
| CAJ21276 | [Avena sativa] |
| ABK55381 | [Triticum aestivum] |
| ABK55382 | [Triticum aestivum] |
| BAF36844 | [Lolium perenne] |
| ABK55384 | [Triticum aestivum] |
| AAY32552 | [Triticum monococcum] |
| ABA25905 | [Hordeum vulgare subsp. vulgare] |
| ABK55383 | [Triticum aestivum] |
| AAY32562 | [Triticum monococcum] |
| ABK55380 | [Triticum aestivum] |
| AAX23696 | [Hordeum vulgare subsp. vulgare] |
| AAX28951 | [Hordeum vulgare subsp. vulgare] |
| BAF36846 | [Lolium perenne] |
| ABF59742 | [Elaeis guineensis] |
| AAX23690 | [Hordeum vulgare subsp. vulgare] |
| ABF59744 | [Dypsis lutescens] |
| ABA01494 | [Hordeum vulgare subsp. vulgare] |
| AAX23689 | [Hordeum vulgare subsp. vulgare] |
| AAL35760 | [Secale cereale] |
| ABK55378 | [Triticum aestivum] |
| ABB54457 | [Hordeum brevisubulatum] |
| ABF59745 | [Cocos nucifera] |
| ABB84399 | [Triticum aestivum] |
| ABK55387 | [Triticum aestivum] |
| ABF59739 | [Ravenea rivularis] |
| ABF59738 | [Trachycarpus fortunei] |
| AAX28959 | [Sorghum bicolor] |
| ABF59749 | [Rhapidophyllum hystrix] |
| ABK55390 | [Triticum aestivum] |
| ABK55388 | [Triticum aestivum] |
| ABK55379 | [Triticum aestivum] |
| ABF59737 | [Sabal minor] |
| ABF59736 | [Sabal palmetto] |
| ABK55355 | [Triticum aestivum] |
| AAX28966 | [Triticum aestivum] |
| EAZ24170 | [Oryza sativa (japonica cultivar-group)] |
| ABF59748 | [Rhapidophyllum hystrix] |
| AAX28961 | [Triticum aestivum] |
| ABK55385 | [Triticum aestivum] |
| ABK55372 | [Triticum aestivum] |
| ABK55386 | [Triticum aestivum] |
| EAY87059 | [Oryza sativa (indica cultivar-group)] |
| AAX23709 | [Hordeum vulgare subsp. vulgare] |
| AAX28955 | [Hordeum vulgare subsp. vulgare] |
| AAY32560 | [Triticum monococcum] |
| BAE17131 | [Lycopersicon hirsutum] |
| EAZ35676 | [Oryza sativa (japonica cultivar-group)] |
| AAX28952 | [Hordeum vulgare subsp. vulgare] |

TABLE Y1-continued

DREB protein sequences originating from different organisms.

| GenBank Accession Number | Source organism |
|---|---|
| AAL35761 | [Secale cereale] |
| AAS00621 | [Thellungiella salsuginea] |
| AAZ22480 | [Capsicum annuum var. annuum] |
| ABK55373 | [Triticum aestivum] |
| AAX23698 | [Hordeum vulgare subsp. vulgare] |
| AAR88363 | [Capsicum annuum] |
| AAX23700 | [Hordeum vulgare subsp. vulgare] |
| AAR35030 | [Capsella bursa-pastoris] |
| AAX28963 | [Triticum aestivum] |
| AAR26658 | [Capsella bursa-pastoris] |
| AAZ20446 | [Malus x domestica] |
| AAR20499 | [Brassica napus] |
| ABK55356 | [Triticum aestivum] |
| ABK55357 | [Triticum aestivum] |
| ABE96792 | [Vitis vinifera] |
| AAX23686 | [Hordeum vulgare subsp. vulgare] |
| ABK55354 | [Triticum aestivum] |
| ABC86564 | [Triticum aestivum] |
| EAY95226 | [Oryza sativa (indica cultivar-group)] |
| AAS77819 | [Lycopersicon esculentum] |
| ABD63908 | [Brassica rapa subsp. chinensis] |
| AAX23720 | [Hordeum vulgare subsp. vulgare] |
| ABK55389 | [Triticum aestivum] |
| AAW58104 | [Vitis riparia] |
| AAY32551 | [Triticum monococcum] |
| AAY43213 | [Hevea brasiliensis] |
| AAC99369 | [Arabidopsis thaliana] |
| AAZ57434 | [Iris lactea var. chinensis] |
| ABG38530 | [Cucumis sativus] |
| AAC99371 | [Arabidopsis thaliana] |
| AAS77820 | [Lycopersicon esculentum] |
| AAP83325 | [Oryza sativa (japonica cultivar-group)] |
| AAR20500 | [Brassica napus] |
| AAD45623 | [Brassica napus] |
| AAM18960 | [Brassica napus] |
| ABE66241 | [Arabidopsis thaliana] |
| CAH10191 | [Festuca arundinacea] |
| ABK28752 | [Arabidopsis thaliana] |
| AAV80413 | [Arabidopsis thaliana] |
| AAG43549 | [Nicotiana tabacum] |
| ABI93900 | [Arabidopsis thaliana] |
| AAP83936 | [Gossypium hirsutum] |
| ABD14412 | [Arabidopsis thaliana] |
| AAM18959 | [Brassica napus] |
| ABD42992 | [Arabidopsis thaliana] |
| AAR20498 | [Brassica napus] |
| AAS77821 | [Lycopersicon esculentum] |
| AAY43345 | [Brassica rapa subsp. pekinensis] |
| ABD65969 | [Nicotiana tabacum] |
| ABM21468 | [Capsella bursa-pastoris] |
| AAR11858 | [Brassica napus] |
| ABA42927 | [Arabis pumila] |
| AAM18958 | [Brassica napus] |
| ABC79627 | [Populus tomentosa] |
| AAR20497 | [Brassica napus] |
| AAV80414 | [Arabidopsis thaliana] |
| AAV80415 | [Arabidopsis thaliana] |
| ABD65473 | [Gossypium hirsutum] |
| AAY21899 | [Arabidopsis thaliana] |
| CAA18178 | [Arabidopsis thaliana] |
| CAB81358 | [Arabidopsis thaliana] |
| AAQ98869 | [Gossypium hirsutum] |
| ABK55374 | [Triticum aestivum] |
| AAQ02702 | [Brassica oleracea] |
| AAG43548 | [Nicotiana tabacum] |
| Os06g0165600 | [Oryza sativa (japonica cultivar-group)] |
| BAD27123 | [Prunus avium] |
| AAL38242 | [Brassica napus] |
| ABB51638 | [Eucalyptus gunnii] |

TABLE Y2

Preferred DREB genes and DREB proteins relevant the invention

| Description | Nucleotide (Nt)/ Proteins (PROT) | Origin Species | SEQ ID NO: |
|---|---|---|---|
| Os09g0522200 | Nt | [Oryza sativa (japonica cultivar-group)] | 335 |
| Os09g0522200 | PROT | [Oryza sativa (japonica cultivar-group)] | 336 |
| Os08g0545500 | Nt | [Oryza sativa (japonica cultivar-group)] | 351 |
| Os08g0545500 | PROT | [Oryza sativa (japonica cultivar-group)] | 352 |
| Os09g0522100 | Nt | [Oryza sativa (japonica cultivar-group)] | 353 |
| Os09g0522100 | PROT | [Oryza sativa (japonica cultivar-group)] | 354 |
| Os08g0545400 | Nt | [Oryza sativa (japonica cultivar-group)] | 355 |
| Os08g0545400 | PROT | [Oryza sativa (japonica cultivar-group)] | 356 |
| Os06g0165600 | Nt | [Oryza sativa (japonica cultivar-group)] | 357 |
| Os06g0165600 | PROT | [Oryza sativa (japonica cultivar-group)] | 358 |
| Os09g0522000 | Nt | [Oryza sativa (japonica cultivar-group)] | 359 |
| Os09g0522000 | PROT | [Oryza sativa (japonica cultivar-group)] | 360 |
| Os02g0677300 | Nt | [Oryza sativa (japonica cultivar-group)] | 361 |
| Os02g0677300 | PROT | [Oryza sativa (japonica cultivar-group)] | 362 |
| Os06g0127100 | Nt | [Oryza sativa (japonica cultivar-group)] | 363 |
| Os06g0127100 | PROT | [Oryza sativa (japonica cultivar-group)] | 364 |
| OsDREB1B | Nt | [Oryza sativa (indica cultivar-group)] | 365 |
| OsDREB1B | PROT | [Oryza sativa (indica cultivar-group)] | 366 |
| ZmCBF1 | Nt | [Zea mays] | 367 |
| ZmCBF1 | PROT | [Zea mays] | 368 |
| ZmCBF2 | Nt | [Zea mays] | 369 |
| ZmCBF2 | PROT | [Zea mays] | 370 |
| ZmCBF3 | Nt | [Zea mays] | 371 |
| ZmCBF3 | PROT | [Zea mays] | 372 |
| ZmDREB1 | Nt | [Zea mays] | 373 |
| ZmDREB1 | PROT | [Zea mays] | 374 |
| ZmDREB1B | Nt | [Zea mays] | 375 |
| ZmDREB1B | PROT | [Zea mays] | 376 |
| TaCBF1 | Nt | [Triticum aestivum] | 377 |

TABLE Y2-continued

Preferred DREB genes and DREB proteins relevant the invention

| Description | Nucleotide (Nt)/ Proteins (PROT) | Origin Species | SEQ ID NO: |
|---|---|---|---|
| TaCBF1 | PROT | [Triticum aestivum] | 378 |
| TaCBF2 | Nt | [Triticum aestivum] | 379 |
| TaCBF2 | PROT | [Triticum aestivum] | 380 |
| TaCBF3 | Nt | [Triticum monococcum] | 381 |
| TaCBF3 | PROT | [Triticum monococcum] | 382 |
| TaCBF4 | Nt | [Triticum monococcum] | 383 |
| TaCBF4 | PROT | [Triticum monococcum] | 384 |
| TaCBF5 | Nt | [Triticum monococcum] | 385 |
| TaCBF5 | PROT | [Triticum monococcum] | 386 |
| DBP3b | Nt | [Gossypium hirsutum] | 387 |
| DBP3b | PROT | [Gossypium hirsutum] | 388 |
| DBP3a | Nt | [Gossypium hirsutum] | 389 |
| DBP3a | PROT | [Gossypium hirsutum] | 390 |
| DREB1A | Nt | [Gossypium hirsutum] | 391 |
| DREB1A | PROT | [Gossypium hirsutum] | 392 |
| DREB1 | Nt | [Gossypium hirsutum] | 393 |
| DREB1 | PROT | [Gossypium hirsutum] | 394 |
| DREB1L | Nt | [Gossypium hirsutum] | 395 |
| DREB1L | PROT | [Gossypium hirsutum] | 396 |
| DREB2a | Nt | [Glycine max] | 397 |
| DREB2a | PROT | [Glycine max] | 398 |
| DREBa | Nt | [Glycine max] | 399 |
| DREBa | PROT | [Glycine max] | 400 |
| DREB2b | Nt | [Glycine max] | 401 |
| DREB2b | PROT | [Glycine max] | 402 |
| DREB3 | Nt | [Glycine max] | 403 |
| DREB3 | PROT | [Glycine max] | 404 |
| DREB | Nt | [Glycine max] | 405 |
| DREB | PROT | [Glycine max] | 406 |
| CBF17 | Nt | [Brassica napus] | 407 |
| CBF16 | PROT | [Brassica napus] | 408 |
| CBF7 | Nt | [Brassica napus] | 409 |
| CBF16 | PROT | [Brassica napus] | 410 |
| CBF7 | Nt | [Brassica napus] | 411 |
| CBF7 | PROT | [Brassica napus] | 412 |
| CBF5 | Nt | [Brassica napus] | 413 |
| CBF5 | PROT | [Brassica napus] | 414 |
| CBF-like protein | Nt | [Brassica oleracea] | 415 |
| CBF-like protein | PROT | [Brassica oleracea] | 416 |

Example 47

Alignment of Relevant DREB Proteins

AlignX from the Vector NTI (Invitrogen) which is based on the popular Clustal algorithm of progressive alignment (Thompson et al. (1997) Nucleic Acids Res 25:4876-4882; Chema et al. (2003). Nucleic Acids Res 31:3497-3500) was used (with default parameters) to perform the multiple alignment of DREB proteins shown in FIG. 24.

The result of the multiple sequence alignment using polypeptides relevant to the invention is shown in FIG. 24. Conserved amino acids between the rice and Arabidopsis thaliana DREB proteins are indicated in the consensus sequence. The regions of highest similarity are that corresponding to the AP2 domain and the CMIII-4 motif.

Example 48

Calculation of Global Percentage Identity Between DRE Proteins

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table Z2 for the global similarity and identity over the full length of the polypeptide sequences (excluding the partial polypeptide sequences). Percentage identity is given above the diagonal and percentage similarity is given below the diagonal.

The percentage identity over the entire amino acid sequence between paralogous DREB proteins in Arabidopsis thaliana varied between 18.5 and 86.9%. Similar range of sequence identity was found between for rice paralogous DREB proteins. Identity between DREB proteins of Arabidopsis thaliana and rice varied between 18.5% and 44.5%.

TABLE Z1

Description of proteins in table Z2

| DREB Protein | Chomosome locus |
|---|---|
| 1 | At4g25470 |
| 2 | At4g36900 |
| 3 | At5g25810 |
| 4 | At1g46768 |
| 5 | At4g25480 |
| 6 | At3g11020 |
| 7 | At2g40220 |
| 8 | At5g05410 |
| 9 | AT4G25490 |
| 10 | AT1G7808 |
| 11 | Os09g0522200 |
| 12 | Os09g0522100 |
| 13 | Os09g0522000 |
| 14 | Os08g0545500 |
| 15 | Os08g0545400 |
| 16 | Os06g0165600 |
| 17 | Os06g0127100 |
| 18 | Os02g0677300 |
| 19 | Os01g0968800 |

TABLE Z2

MatGAT results for global similarity and identity over the full length of the DREB proteins described in Table Z1.

| DREB protein | 1 | 2 | 3 | 4 | 5 | 6 | 7 | 8 | 9 | 10 | 11 | 12 | 13 | 14 | 15 | 16 | 17 | 18 | 19 |
|---|---|---|---|---|---|---|---|---|---|---|---|---|---|---|---|---|---|---|---|
| 1 |  | 26.9 | 33.5 | 27.3 | 87.1 | 21.5 | 20.7 | 24.2 | 86.6 | 22.8 | 38.6 | 37 | 38.4 | 36 | 35 | 27.3 | 42 | 44.7 | 41.3 |
| 2 | 40.3 |  | 25.8 | 45 | 26.1 | 20 | 20.4 | 22.8 | 25.4 | 18.9 | 21.8 | 25.2 | 25.9 | 20.9 | 24.2 | 19.4 | 29.8 | 24.4 | 26.5 |
| 3 | 50 | 40.8 |  | 25.7 | 34.9 | 25.5 | 23.7 | 22.5 | 33.5 | 23.6 | 31.3 | 28.9 | 32.6 | 29.5 | 28.4 | 24.3 | 33.3 | 29.8 | 32.5 |
| 4 | 37.5 | 53.1 | 42.7 |  | 30.1 | 18.5 | 19.2 | 19.9 | 28.6 | 20.1 | 23.5 | 25.2 | 27.4 | 25.5 | 22.3 | 20.6 | 29.4 | 24.6 | 28.8 |
| 5 | 92.6 | 39.8 | 50 | 38.9 |  | 22.2 | 20.4 | 22.8 | 86.2 | 20.7 | 39.2 | 36.5 | 42 | 37.7 | 35.4 | 30.6 | 44.7 | 45.8 | 42.7 |
| 6 | 31.5 | 31.8 | 35.8 |  | 32.1 |  | 24 | 52.3 | 23.3 | 20.5 | 19.9 | 19.9 | 22.2 | 20.7 | 20.8 | 19.4 | 20.5 | 19.4 | 19.6 |
| 7 | 32 | 29.3 | 35.7 | 25.9 | 32.6 | 37.6 |  | 24.6 | 21.9 | 22.4 | 17.8 | 22 | 21.6 | 18.5 | 22.6 | 17 | 21.3 | 19.8 | 20.5 |
| 8 | 35.8 | 34.4 | 35.1 | 28.8 | 35.4 | 64.2 | 39.3 |  | 22.8 | 22.6 | 21.4 | 21.6 | 24.4 | 22.5 | 23.3 | 19.4 | 22.8 | 23.1 | 19.7 |
| 9 | 90.3 | 40.4 | 50.9 | 39.9 | 90.7 | 33 | 34.5 | 35.4 |  | 21.6 | 40 | 36 | 43 | 36.5 | 38.9 | 28.6 | 43.5 | 44.9 | 42 |
| 10 | 29.6 | 26.9 | 33.2 | 27.5 | 29.6 | 37.4 | 38.3 | 37.7 | 28.1 |  | 22.1 | 19.8 | 18.6 | 18.2 | 20.9 | 17.3 | 15.8 | 18.7 | 20 |
| 11 | 53.4 | 35.3 | 47.1 | 34 | 50.4 | 31.2 | 33.2 | 31.8 | 53.4 | 35 |  | 53.5 | 49 | 56.3 | 47.8 | 35.6 | 42.4 | 43.1 | 37.8 |
| 12 | 54.1 | 40.7 | 45.5 | 33.7 | 53.3 | 32.1 | 33.8 | 33.4 | 50 | 32 | 65.9 |  | 46.8 | 47.1 | 49.6 | 35.3 | 40.9 | 39.5 | 39.5 |
| 13 | 58.3 | 37.2 | 49.5 | 35.3 | 61.5 | 30.9 | 32 | 32.1 | 61.9 | 27.5 | 60.5 | 59.8 |  | 49 | 44.9 | 34.9 | 46.3 | 41.9 | 37.9 |
| 14 | 55.8 | 33.9 | 47 | 35.9 | 53 | 33 | 30.8 | 35.1 | 51.8 | 31.1 | 68.9 | 62.9 | 59.8 |  | 47.2 | 35.9 | 43 | 40.2 | 36.9 |
| 15 | 50.4 | 37.2 | 46.3 | 33.1 | 49.2 | 30.6 | 31.7 | 33.4 | 51.2 | 35.6 | 61.2 | 65.9 | 56.2 | 62.9 |  | 50.7 | 40.3 | 42.4 | 34.5 |
| 16 | 41.5 | 32.4 | 40.3 | 27.3 | 43.5 | 32.1 | 32.3 | 31.1 | 41.5 | 29.3 | 49 | 49.8 | 46.2 | 49.8 | 60.9 |  | 31 | 31.7 | 29.9 |
| 17 | 58.3 | 40.2 | 52.3 | 38.3 | 59.3 | 31.5 | 32.9 | 32.5 | 60.7 | 26 | 52.5 | 52.4 | 58.3 | 51 | 54.1 | 39.5 |  | 50 | 38.8 |
| 18 | 64.3 | 41.5 | 52.2 | 33.9 | 62.1 | 29.7 | 32.3 | 31.8 | 60.7 | 32.9 | 55.9 | 52.8 | 58 | 52.2 | 56.6 | 43.9 | 58.9 |  | 44.2 |
| 19 | 56.6 | 42.5 | 51.6 | 37 | 57.5 | 29.1 | 33.8 | 32.1 | 54.3 | 32 | 50 | 48.4 | 53.9 | 47.4 | 49.6 | 40.7 | 51.6 | 58 |  |

Example 49

Identification of AP2 Domains in a Protein

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, GENE3D, PROFILE, Propom and Pfam, Smart and TIGR-FAMs. Interpro is hosted at the European Bioinformatics Institute in the United Kingdom.

The results of the InterPro scan of the polypeptide sequence as represented by SEQ ID NO: 336 are presented in Table AA.

TABLE AA

InterPro scan results of the polypeptide sequence as represented by SEQ ID NO: 336

| Database | accession number | Description hit | e-value [amino acid position of the domain] |
|---|---|---|---|
| InterPro | IPR001471 | Pathogenesis-related transcriptional factor and ERF | |
| PRODOM | PD001423 | Q8LLV0_ORYSA_Q8LLV0; | 5e−15 [61-95]T |
| PRINTS | PR00367 | ETHRSPELEMNT | 6.9e−05 [51-62]T |

TABLE AA-continued

InterPro scan results of the polypeptide sequence as represented by SEQ ID NO: 336

| Database | accession number | Description hit | e-value [amino acid position of the domain] |
|---|---|---|---|
| GENE3D | G3DSA:3.30.730.10 | no description | 6.9e–05 [75-91]T<br>7.7e–15 [49-118]T |
| PFAM | PF00847 | AP2 | 2.5e–21 [48-120]T |
| SMART | SM00380 | AP2 | 1.5e–13 [50-121]T |
| PROFILE | PS51032 | AP2_ERF | 19.664 [50-115]T |

Example 50

Gene Cloning

The *Oryza sativa* DREB1A gene was amplified by PCR using as template an *Oryza sativa* seedling cDNA library (Invitrogen, Paisley, UK). After reverse transcription of RNA extracted from seedlings, the cDNAs were cloned into pCMV Sport 6.0. Average insert size of the bank was 1.5 kb and the original number of clones was of the order of $1.59 \times 10^7$ cfu. Original titer was determined to be $9.6 \times 10^5$ cfu/ml after first amplification of $6 \times 10^{11}$ cfu/ml. After plasmid extraction, 200 ng of template was used in a 50 µl PCR mix. Primers prm07441 (SEQ ID NO: 337; sense: 5'-ggggacaagtttgta-caaaaaagcaggcttaaa caatgtgcgggatcaagca-3') and prm07442 (SEQ ID NO: 338; reverse, complementary: 5'-ggggac-cactttgtacaagaaagctgggtggcaaaattgtacagttgattg-3'), which include the AttB sites for Gateway recombination, were used for PCR amplification. PCR was performed using Hifi Taq DNA polymerase in standard conditions. A PCR fragment of the expected size was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

Example 51

Vector Construction

The entry clone comprising the OsDREB gene coding sequence was subsequently used in an LR reaction with a destination vector used for *Oryza sativa* transformation. This vector contain as functional elements within the T-DNA borders: a plant selectable marker; a screenable marker expression cassette; and a Gateway cassette intended for LR in vivo recombination such that the sequence of interest from the entry clone is integrated in sense or anti sense orientation. A rice GOS2 promoter (SEQ ID NO: 339) for constitutive expression was located upstream of this Gateway cassette.

Figure 26:
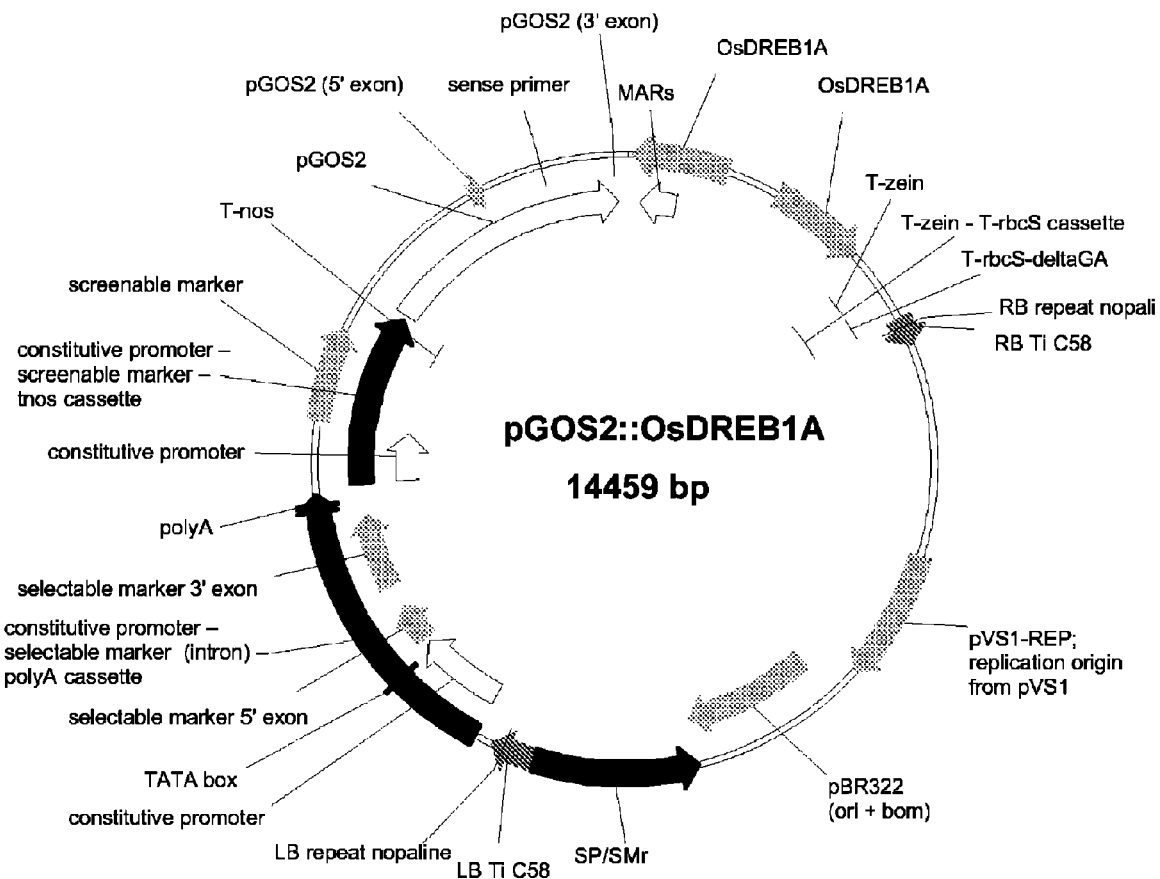
FIG. 26 shows the binary vector for OsDREB1A RNA silencing in *Oryza sativa*, using a hairpin construct under the control of a constitutive promoter (OsGOS2).

After the LR recombination step, the resulting expression vector (FIG. 26) was transformed into *Agrobacterium* strain LBA4044 and subsequently to *Oryza sativa* plants. Transformed rice plants were allowed to grow and were then examined for the parameters described in Example 48.

Example 52

Evaluation Methods of Plants Transformed with OsDREB1A in Downregulation Mode Under Control of the Rice GOS2 Promoter Approximately 15 to 20 independent T0 rice transformants comprising an inverted repeat recombinant DNA for OSDREB1A were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homozygotes) and approximately 10 T1 seedlings lacking the transgene (nullizygotes) were selected by monitoring visual marker expression. The selected T1 plants were transferred to a greenhouse. Each plant received a unique barcode label to link unambiguously the phenotyping data to the corresponding plant. The selected T1 plants were grown on soil in 10 cm diameter pots under the following environmental settings: photoperiod=11.5 h, daylight intensity=30,000 lux or more, daytime temperature=28° C. or higher, night time temperature=22° C., relative humidity=60-70%. Transgenic plants and the corresponding nullizygotes were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The Areamax is the above ground area at the time point at which the plant had reached its maximal leafy biomass.

The mature primary panicles were harvested, bagged, barcode-labelled and then dried for three days in the oven at 37° C. The panicles were then threshed and all the seeds collected. The filled husks were separated from the empty ones using an air-blowing device. After separation, both seed lots were then counted using a commercially available counting machine. The empty husks were discarded. The filled husks were weighed on an analytical balance and the cross-sectional area of the seeds was measured using digital imaging. This procedure resulted in the set of the following seed-related parameters:

The flowers-per-panicle is a parameter estimating the average number of florets per panicle on a plant, derived from the number of total seeds divided by the number of first panicles. The tallest panicle and all the panicles that overlapped with the tallest panicle when aligned vertically, were considered as first panicles and were counted manually. The number of filled seeds was determined by counting the number of filled husks that remained after the separation step. The total seed yield (total seed weight) was measured by weighing all filled husks harvested from a plant. Total seed number per plant was measured by counting the number of husks harvested from a plant and corresponds to the number of florets per plant. These parameters were derived in an automated way from the digital images using image analysis software and were analysed statistically. Individual seed parameters (including width, length, area, weight) were measured using a custom-made device consisting of two main components, a weighing and imaging device, coupled to software for image analysis.

A two factor ANOVA (analyses of variance) corrected for the unbalanced design was used as statistical model for the overall evaluation of plant phenotypic characteristics. An F-test was carried out on all the parameters measured of all the plants of all the events transformed with that gene. The F-test was carried out to check for an effect of the gene over all the transformation events and to verify for an overall effect of the gene, also named herein "global gene effect". If the value of the F test shows that the data are significant, than it is concluded that there is a "gene" effect, meaning that not only presence or the position of the gene is causing the effect. The threshold for significance for a true global gene effect is set at 5% probability level for the F test.

To check for an effect of the genes within an event, i.e., for a line-specific effect, a t-test was performed within each event using data sets from the transgenic plants and the corresponding null plants. "Null plants" or "null segregants" or "nullizygotes" are the plants treated in the same way as the transgenic plant, but from which the transgene has segregated. Null plants can also be described as the homozygous negative transformed plants. The threshold for significance for the t-test is set at 10% probability level. The results for some events can be above or below this threshold. This is based on the hypothesis that a gene might only have an effect in certain positions in the genome, and that the occurrence of this position-dependent effect is not uncommon. This kind of gene effect is also named herein a "line effect of the gene". The p-value is obtained by comparing the t-value to the t-distribution or alternatively, by comparing the F-value to the F-distribution. The p-value then gives the probability that the null hypothesis (i.e., that there is no effect of the transgene) is correct.

Example 53

Measurement of Yield-Related Parameters for Antisense Construct Transformants

Upon analysis of the seeds as described above, the inventors found that plants transformed with the antisense OsDREB1A gene construct had a higher seed yield, expressed as number of filled seeds, total weight of seeds, total number of seeds, number of panicles per plant, and flowers per panicle, compared to plants lacking the OsDREB1A transgene. Additionally the transgenic seedling showed an increased vigour compared to the control seedlings. The p-values show that the increases were significant.

The results obtained for plants in the T1 generation are summarised in Table BB, which represent the mean values for all the tested lines:

TABLE BB

Results of the evaluation

| Trait | Percentage of improvement |
|---|---|
| Seedling Vigour | 11% |
| Total Seed Yield | 13% |
| Nr of filled seeds | 14% |
| Nr of first panicles per plant | 13% |
| Nr of total seeds | 14% |
| Harvest Index | 9% |

Example 54

Transformation of Other Plant Species

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

SEQUENCE LISTING (427 sequences)

SEQ ID NO: 1 - DNA, 1075 bp, Arabidopsis thaliana
gtgacggaaccacaagaagagaagagaccaaaaggaggagccaaaatcctctctttctttggaattagggtttcctcaaaggaagtgaactgaaaatggtcgcggacaagagcaagaagtcgaaaattgaagagaaaggcgaagaagaaaacttggagcaaatcgacgcagagcttgttctctcaattgagaagcttcaggagattcaagacgacctcgagaagattaacgaaaaggccagtgacgaggtcttggaagtagagcagaaatataacgtgatacggaaacctgtctatgacaagcgcaatgaagttatccaatcgattcctggcttttggatgactgcttttttgagtcatcctgccttaggcgacctcttgactgaagaagaccaaaagatttttaagtacttgaactctctggaagtggaggatgccaaagatgtgaaatctggatactctataacttttcacttcacttcaaacccgttctttgaggatgccaagcttaccaagacatttactttccttgaagaaggaacaacaaaaatcactgcaactcctatcaaatggaaggagggcaagggcttgccaaatggagtgaaccatgatgataagaaaggaaataaacgtgcattgccagaggagagtttctttacttggtttactgatgctcaacataaggaagatgctggggatgagattcatgatgaggttgctgatattatcaaggaagatctctggtccaaccctctcacctacttcaacaatgatgctgatgaagaggattttgatggagatgatgatggtgacgaagagggagaagaagacgatgacgatgaagaggaggaagatggtgaggaatgatgggagcccaaagataacacattgctggcttgcttctataacagatgtgtaaagtttgtgttatgaggttctcaattttagcaatgatgagactaagctttctcttttggaatatttagtttatttactatcaatagctacattctgtttgtacgaaccatgtcatcatccatgtcctaaatcttgccataactacatctgtttttcgc

SEQ ID NO: 2 - protein, 256 aa, Arabidopsis thaliana
MVADKSKKSKIEEKGEEENLEQIDAELVLSIEKLQEIQDDLEKINEKASDEVLEVEQKYNVIRKPVYDKRNEVIQSIPGFWMTAFLSHPALGDLLTEEDQKIFKYLNSLEVEDAKDVKSGYSITFHFTSNPFFEDAKLTKTFTFLEEGTTKITATPIKWKEGKGLPNGVNHDDKKGNKRALPEESFFTWFTDAQHKEDAGDEIHDEVADIIKEDLWSNPLTYFNNDADEEDFDGDDDGDEEGEEDDDDEEEEDGEE

SEQ ID NO: 3 - DNA, 3561 bp, Artificial sequence
  expression cassette
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttcacaatggtcgcggacaagagcaagaagtcgaaaattgaagagaaaggcgaagaagaaaacttggagcaaatcgacgcagagcttgttctctcaattgagaagcttcaggagattcaagacgacctcgagaagattaacgaaaaggccagtgacgaggtcttggaagtagagcagaaatataacgtgatacggaaacctgtctatgacaagcgcaatgaagttatccaatcgattcctggcttttggatgactgcttttttgagtcatcctgccttaggcgacctcttgactgaagaagaccaaaagatttttaagtacttgaactctctggaagtggaggatgccaaagatgtgaaatctggatactctataacttttcacttcacttcaaacccgttctttgaggatgccaagcttaccaagacatttactttccttgaagaaggaacaacaaaaatcactgcaactcctatcaaatggaaggagggcaagggcttgccaaatggagtgaaccatgatgataagaaaggaaataaacgtgcattgccagaggagagtttctttacttggtttactgatgctcaacataaggaagatgctggggatgagattcatgatgaggttgctgatattatcaaggaagatctctggtccaaccctctcacctacttcaacaatgatgctgatgaagaggattttgatggagatgatgatggtgacgaagagggagaagaagacgatgacgatgaagaggaggaagatggtgaggaatgatgggacccagctttcttgtacaaagtggtgatatcacaagcccgggcggtcttctagggataacagggtaattatatccctctagatcacaagcccgggcggtcttctacgatgattgagtaataatgtgtcacgcatcaccatgggtggcagtgtcagtgtgagcaatgacctgaatgaacaattgaaatgaaaagaaaaaaagtactccatctgttccaaattaaaattcattttaaccttttaataggtttatacaataattgatatatgttttctgtatatgtctaatttgttatcatccgggcggtcttctagggataacagggtaattatatccctctagacaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaac

SEQ ID NO: 4 - DNA, 51 bp, Artificial sequence
  primer: prm1505
ggggacaagtttgtacaaaaaagcaggcttcacaatggtcgcggacaagag

SEQ ID NO: 5 - DNA, 48 bp, Artificial sequence
  primer: prm1506
ggggaccactttgtacaagaaagctgggtcccatcattcctcaccatc

SEQ ID NO: 6 - DNA, 1101 bp, Nicotiana tabacum
agcggctggtaccggtccggaattcccgggatatcgtcgacccacgcgtccgaaagaagagaaaaagatgggtgctgacaaagggaagaagcaaaaagtggaggaagagaacaacaccattgatggtgagctcgttttttccattgaaaaattgcaagaaatacaagacgagctcgagaagatcaatgaggaagcaagtgataaagtattggaagtggaacagaagtacaatgagatccgcaagcctgtctatgacaaacgaaacgacatcattaaagctatcccggacttctggttgactgcttttttgagtcatcctgtcctaggtgaacttctaactgaagaagaccaaaagatcttcaagtttctaagttctattgaagttgaagactctaaagatgtgaagtcgggctactcgataacctttaacttcaatgcgaatccttattttgaaaatacaaagctcacaaagacctataccttccttgaagatggacccacaaagatttctgctacaacaataaaatggaaagaaggcatgggcattcctaatggatttgcacatgagaagaaaggaaacaagcgatctcatgctgaggaaagcttcttcacatggttcagtgaagtcaatcaaaaagatgaggatgaggatgaggccctagagattcaggatgaggtcgctgacataattaaggatgacttgtggccgaaccctctcacctattttaacaacgagcctgatgaagaagattttgatggtgacgagggaaaggacagtgaaggctctgaagacgaagaggaagaagaagaggaggatgaggatggtgatgaagaatgaaggcagtaaactgttcaagacccctattttgggatctcgtcttcagcggttttaatcatcagggtttaatgtctgtaaagaggctttgaatgttgccaaagaacagaataactgtggtgactataccttttcttctcttgtatggttataacttataagcaaaatatctaattccggaggttccaaaatgttttcattaggctagttcgattaatgaagtgtttgtctggcaaaaactgataatgttaggttattgagttatg

SEQ ID NO: 7 - protein, 256 aa, Nicotiana tabacum
MGADKGKKQKVEEENNTIDGELVFSIEKLQEIQDELEKINEEASDKVLEVEQKYNEIRKPVYDKRNDIIKAIPDFWLTAFLSHPVLGELLTEEDQKIFKFLSSIEVEDSKDVKSGYSITFNFNANPYFENTKLTKTYTFLEDGPTKISATTIKWKEGMGIPNGFAHEKKGNKRSHAEESFFTWFSEVNQKDEDEDEALEIQDEVADIIKDDLWPNPLTYFNNEPDEEDFDGDEGKDSEGSEDEEEEEEEDEDGDEE

SEQ ID NO: 8 - DNA, 1061 bp, Nicotiana tabacum
tttgtacaaaaaagcaggctggtaccggtccggaattcccgggatatcgtcgacccacgcgtccgagaaattagcagttagagacactgagaagcagcagctctcttcctcagctgctgtgtgcttaggcaaagaataaaatgggggcagacaaagggaagaagcagaaagtggatgaggaaaacaacaatgttattgatgaaaagctcattttttccattgaaaaattgcaagagatacaagacgagctcgagaagatcaatgaaaaagcaagcgacgaagtgttggaagtagaacagaagtacaacgagatccgcaagcctgtctacgataagcgaaatgatgtcattagctctatttctgacttctggttgactgcttttttgagtcatcctgttcttggtaaccttctcactgaagaggaccaaaagattttcaaatttgtaagttctattgaagtggaagactcaaaggatgtgaaatcgggtcattcaatcacgtttaactttaagcccaatccttattttgaaaattcaaagctctcaaagacgtataccttccttgaagatggacctacaaaaattacagctacaacaataaaatggaaagaaggcatgggcattcctaatggagttgctgacaagaagaaaggaaacaagcggtcccacgctgaagaaagtttctttacatggttcagtgaagtcaatcaaaaaggtgatgtggatgatgacgaaaatgagattctggacattcaggatgatgaggttgctgaaataatcaaggatgacttgtggcctaaccctctcaattattttgaccatgagcctgatgaagaagatattgagggcgatgagggaaaggacagcggaggctctgaagaggaagaagaagaggaagatgatgaagatgaagaagacgaatgaactgttggtagaccttgtgtttgatttgagttctcatcagtgtttcaatcatcagagttggtctctgtaaagaggtttcggatattgcagaaaaattgaatgacatatagtggtgactctaatttttagtttcagtga

SEQ ID NO: 9 - protein, 260 aa, Nicotiana tabacum
MGADKGKKQKVDEENNNVIDEKLIFSIEKLQEIQDELEKINEKASDEVLEVEQKYNEIRKPVYDKRNDVISSISDFWLTAFLSHPVLGNLLTEEDQKIFKFVSSIEVEDSKDVKSGHSITFNFKPNPYFENSKLSKTYTFLEDGPTKITATTIKWKEGMGIPNGVADKKKGNKRSHAEESFFTWFSEVNQKGDVDDDENEILDIQDDEVAEIIKDDLWPNPLNYFDHEPDEEDIEGDEGKDSGGSEEEEEEEDDEDEEDE

SEQ ID NO: 10 - DNA, 1210 bp, Medicago sativa
  misc_feature (1014)..(1014): n is a, c, g, or t
ggcacgagcaaaaccctaacacttccctcattcacgctcgaagaaaagaacacaaatctctccactgcgctagggtttgaaacccaacaccttctgtttcttcaaccatggtggccgacaagtctaagaagttgaaagtttctgaaaagggtgaaaacgctgaagagatcgacggagaacttgttctctccattgaaaagttgcaggaaattcaagatgagattgaaaagatcaatgaggaggctagcgataaagttctcgaaatagagcagaagtacaatgaagtaaggaaaccggtgtatgacaagcgcaatgatgtgatcaagtccattcccgatttctggctaactgcgtttttgagccatcctgttcttggtgatctcttgaatgaagaagatcagaagatatttaagcatttaatctctcttgaggtggaagatcataaagatgttaaatcaggctattcaatcacatttaacttcgactccaatcccttttttgaggattcaaaacttgttaagacttttaccttccttgaagaaggaaccacaaagcttaccgccacacccataaaatggaaagagggcaagggcattcccaatggagttattcatgagaagaaagggaacaagcgagctgcttctgatatcagtttctttacctggttttgtgacactgagcagaaagatgaaatgggtgacattcatgatgagattgctgaaatgatcaaggatgatttatggccgaatccactcaattatttcaacagtgaggaccctgatgaagcagaggaggaggatgatgaagctggtgatgcgggaaaggatgatgatgactctgaagatgatgatgatcaagaggatgacgacgatgacgaggaagaagaatagtgtaaaatgctttaaaatagtaatacttggttttaatttatttattttaaggttattataggagtatcttagtggtctttaggggatgatgaaagaccaaggttggctattggttttccccctntgggcgtaaaccttatttattgtgctttgaaggtgatttctggttttatctttgtgcgcttctttcaagataccaatgatacatcggattttatcttagtcctatattgaaaccatatagtagttaaaatgtagtatattcagtgtatagctgcgtaatcagtatcattttattgctatcacaactttacagtacc

SEQ ID NO: 11 - protein, 260 aa, Medicago sativa
MVADKSKKLKVSEKGENAEEIDGELVLSIEKLQEIQDEIEKINEEASDKVLEIEQKYNEVRKPVYDKRNDVIKSIPDFWLTAFLSHPVLGDLLNEEDQKIFKHLISLEVEDHKDVKSGYSITFNFDSNPFFEDSKLVKTFTFLEEGTTKLTATPIKWKEGKGIPNGVIHEKKGNKRAASDISFFTWFCDTEQKDEMGDIHDEIAEMIKDDLWPNPLNYFNSEDPDEAEEEDDEAGDAGKDDDDSEDDDDQEDDDDDEEEE

SEQ ID NO: 12 - DNA, 907 bp, Zea mays
gttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactgaagaggatcagaagatattcaagtacttggactccattgatgtcgatgattctgatgttaaggcaggatattccatttaccttaacttctctgagaacccgtactttgaagacacaaagcttacaaagacctattcctttgttgatgatggaacaaccacaataaaagcttctcaaattaagtggaaggatggaatgggacctgcaaatggaaatggtattaacaagaagggaaacaagcggccattagtagtggaaagttttttctcctggtttagtgatacagagctcaagagtcttgctgatggtgtgcaagatgaggtggcggagatcatcaaggaagacttgtggcctaatcctttgaagtacttcaacaatgaggttgaagatgaatttgaaggagatgaagaagatgatgacgacgacgacgacgatgataatttggatggtgatgacaatgacgatgatggggaccaggagaactgagccctcgcgtttaggcggggaattatgtg

SEQ ID NO: 13 - protein, 258 aa, Zea mays
MTAPADKGKKAKTDADGGEENEQIDGALVFSIEKLQEIQDELEKVNEEASDKVMEVEQKYSEIRRPVYLKRGDIIKTIPDFWLTAFLSHPLLSELLTEEDQKIFKYLDSIDVDDSDVKAGYSIYLNFSENPYFEDTKLTKTYSFVDDGTTTIKASQIKWKDGMGPANGNGINKKGNKRPLVVESFFSWFSDTELKSLADGVQDEVAEIIKEDLWPNPLKYFNNEVEDEFEGDEEDDDDDDDDDNLDGDDNDDDGDQEN

SEQ ID NO: 14 - DNA, 780 bp, Oryza sativa
atggcggcggcggagcagaaggggaagaagccgaggaccgacggcgcggaggccgagcccgtcgacgccgccctgctgcagtccatcgagaagctccaggagatccaggacgagatcgagaaggttaatgaggaagcatgtgataaagttctggagttggaacagaaatacaacgaggttcgcagaccagtttatgttcgacggaataaaattatcaagcaaattcctgacttctggctgacagcgtttcttagccatcctatgcttggtgaactattaactgaagatgatcaaaagattttcaaacacttggagtctatcgacgtggatgactcagaagatatcaaatcaggctactccattactctcacattctcccccaatccatattttgaagatacaaagcttacaaaaacatattcctttagtgacgatgaagcagtcaaagtaaaggctacctccatcaggtggaagaaaggaatggatattgccaatgatcgtgcgtacacgaagaaaggggacaagcgaatcttaattgatgaaagtttctttacttggttcaatagtgaaaagaacagaagttttgctcatggagctatggatgaggtggcagatgtcatcaaggaagatctgtggcctaatcctttgaagtacttcaacaatgaatttgaagaagaattagagctactggatgacgatgacgaggtatctgatgatgacgatgaggaggaggatgatgaagaccaaggtgaaggagaggaggatggagaggagaactga

SEQ ID NO: 15 - protein, 259 aa, Oryza sativa
MAAAEQKGKKPRTDGAEAEPVDAALLQSIEKLQEIQDEIEKVNEEACDKVLELEQKYNEVRRPVYVRRNKIIKQIPDFWLTAFLSHPMLGELLTEDDQKIFKHLESIDVDDSEDIKSGYSITLTFSPNPYFEDTKLTKTYSFSDDEAVKVKATSIRWKKGMDIANDRAYTKKGDKRILIDESFFTWFNSEKNRSFAHGAMDEVADVIKEDLWPNPLKYFNNEFEEELELLDDDDEVSDDDDEEEDDEDQGEGEEDGEEN

SEQ ID NO: 16 - DNA, 1315 bp, Oryza sativa
ctccgctctcctccagctccgcctccgacgcgcgcacgcctctccctcccctcctcctccgcctcgcctcgcagtgtggaagaaaggaaggaaggctaaaaccctagcgagcgcgcgagcgagcgagggctctctgcttccttgcgatgacggcgccggcggacaaggggaagaaggccaagaccgacgccgacggcggcgccgccgaggagaacgagcagatcgacggcgccctcgtcctctccatcgagaagctccaggagatccaggacgagctcgagaaggtcaatgaggaagctagtgacaaggttttggaggtcgagcagaaatacagtgagattcgcagacctgtctatctccgaaggagtgacgttatccaaacaatccccgacttctggctgacagcgtttctgagtcatcctctacttagtgagcttttgaccgaagaggatcaaaagatgttcaagtacctggagtctgtcgacgtggatgattctaaagatgtcaagtcaggctactccataactcttaccttctccgagaacccgtactttgaagacaaagagctcacgaagacatatgccttcgctgatgacggaacaaccacaataaatgctactagcattaagtggaaagaaggaatggaaattgcaaatgggaatgccaagaagaaagggagcaagcgaccattggttgaggaaagtttcttcacctggtttactgatacagagcacaagagtcttgctgatggtgtgcaagatgaggtggctgagatcatcaaggaagacctgtggcccaatccattgaagtatttcaataatgaggctgaagagttaggagaggatgacgacgaagaggggtctgatgctgatgagggtgaagaggatgaggaggaggagaactgagtctaggatgtcagattgcgatggtgccgatcgtctgcattttgtggatgctgtcactctgaagggcgaagttgcgtgaccctcggttgcttctttcttttttctttttgatgacttagctggaacccttaggaactgtttaatgccttatggagtccgtcgtattttcgactcaaaggagacacctctatatcataatctgcgtataaccatggaagacattttaacctgctgatgtgtggttcattgcgctgcctctggtgctgtagggtgttcgttcctttgtgctctctgtcttttttttttttttttgtgtgtgtgtggtcgcgctggcattgttgccagtctgatgggctgttatttctccccctagaaagagtgaaaaacctggcttgtgatcattgtttacg

SEQ ID NO: 17 - protein, 252 aa, Oryza sativa
MTAPADKGKKAKTDADGGAAEENEQIDGALVLSIEKLQEIQDELEKVNEEASDKVLEVEQKYSEIRRPVYLRRSDVIQTIPDFWLTAFLSHPLLSELLTEEDQKMFKYLESVDVDDSKDVKSGYSITLTFSENPYFEDKELTKTYAFADDGTTTINATSIKWKEGMEIANGNAKKKGSKRPLVEESFFTWFTDTEHKSLADGVQDEVAEIIKEDLWPNPLKYFNNEAEELGEDDDEEGSDADEGEEDEEEEN

SEQ ID NO: 18 - DNA, 958 bp, Zea mays
ccaaaagggtcacagttccgcctccttttcctgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagcttctgactgaagaggaccagaagatattcaagtacttagactccattgatgtggatgattctgatgttaaggcaggatactccattcatcttaacttctctgagaacccgtactttgaggacacaaagcttgcaaagacctatatctttgctgatgatggaacaaccacaataaaagcttccgaaattaagtggaaggaaggaatgggacctgcaaatggaaatggtattaacaagaaggggagtaagcggccattagtagaggaaagtttttttagctggtttggtgatacagagctcaagagtcttgctgatggtgtgcaagatgaggtggcggagatcataaaggaagatttgtggcctaatcctttgaagtacttcaacaatgaggttgacgatgaatttgaaggagatgaagatgatgatgatttggatggtgatgatgacgatgaaggcgatgatttggagaactgagcccttgcgcttggttcagaatgttgtccgtggatgatgtggctgggcggaactgtgacccttttgg

SEQ ID NO: 19 - protein, 251 aa, Zea mays
MTAPADKGKKAKTDADGGEENEQIDGVLVLSIEKLQEIQDELEKVNEEASDKVMEVEQKYSEIRRPVYLKRGDIIKTIPDFWLTAFMSHPLLSELLTEEDQKIFKYLDSIDVDDSDVKAGYSIHLNFSENPYFEDTKLAKTYIFADDGTTTIKASEIKWKEGMGPANGNGINKKGSKRPLVEESFFSWFGDTELKSLADGVQDEVAEIIKEDLWPNPLKYFNNEVDDEFEGDEDDDDLDGDDDDEGDDLEN

SEQ ID NO: 20 - DNA, 1257 bp, Arabidopsis thaliana
agattcacgcatcacacaatcgagtttttagggttttagcggttgctctctcggaagccagagagaagagggaagaggaagtctaattcctctgcgttttttgcaattagggttttctcaattggaatcgaaaatggtgacagacaagagcaagaaggcgaaaaccgaagaagaaaacgtcgagcaaatcgatgcagagcttgtcctctcaatcgaaaagcttcaagagatccaagacgacctcgagaagataaatgaaaaggctagtgatgaagtgttggaagtggagcagaaatataatgtgataaggaaacctgtttatgacaagcgtaacgagatcatcaaaaccatccctgatttctggttaactgctttcttgagtcaccctgctttaggtgaacttttgactgaagaagaccaaaagattttcaaatatcttagctctcttgatgttgaggatgccaaagatgtgaaatctggatactctatcactttttccttcaatcccaatccattttttgaagatggaaaactgacaaagacttttacctttctcgaagaagggacaaccaaaatcacagccacgcctatcaaatggaaagagggcaaaggcctggcgaatggagtgaatcatgagaagaatggaaacaaacgtgcactacctgaagagagcttctttacctggtttagtgatgctcaacacaaggaggatgttgaggatgagatgcaagacgagcaggttgcagatatcatcaaggaagatttgtggcccaaccctctcacctacttcaacaatgacgctgatgaagaggactttgatggagacgatgatggagatgaagaggagaaagaaggtgactctgatgaagatgatgacgaagaagacgaagttggtgaggaatgatggcagggatacccagaaaccacatttgcttacatgtcttctctataacagagtgtgtaaagttttgtgtgttgaaaggtttttaattttaagcaaaagtggattatgacgacaacagacaagcttttaattttattttaccgtaatagttatatcttgttgtaagaaaccattttcagccttttgttggaaaatcctgcttaaatggtttttgagtcttacataatagcttcttcatcttttgtcttcttaaagagaattatatttgtaatttcatgtctgttgtgtttctttgactttactgaatagagaatttgtgtgtttatggtgaaaatatagccgatctgcttgac

SEQ ID NO: 21 - protein, 256 aa, Arabidopsis thaliana
MVTDKSKKAKTEEENVEQIDAELVLSIEKLQEIQDDLEKINEKASDEVLEVEQKYNVIRKPVYDKRNEIIKTIPDFWLTAFLSHPALGELLTEEDQKIFKYLSSLDVEDAKDVKSGYSITFSFNPNPFFEDGKLTKTFTFLEEGTTKITATPIKWKEGKGLANGVNHEKNGNKRALPEESFFTWFSDAQHKEDVEDEMQDEQVADIIKEDLWPNPLTYFNNDADEEDFDGDDDGDEEEKEGDSDEDDDEEDEVGEE

SEQ ID NO: 22 - DNA, 1003 bp, Lycopersicon esculentum
gcgaaatcaagaaaatcagttaagcagctctgtaactcaggtgggaaaaaggcaaaaaataatggtggttgacaaagggaagaagcagaaagtggaagaggaaagctacattgatgaaaagctcattttttccattgaaaaattgcaagaaatacaagacgaccttgacaagatcaatgagaaagcaagtgaggaagtgttggaaatagaacagaagtacaacaagatccgcaagcctgtttatgataagcggaatgatatcattaactctatttctgacttctggttgactgcttttttgagtcatcctgttcttggtgaccttctaactgaagaggaccaaaagattttcaaattcttaagttctattgaagtggaagactcgaaagatgtgaaatttggttactcaatcacgtttaactttaagcccaatcctttctttgaaaattcaaagctctcaaagacctataccttccttgaagatggacctacaaaaatcacagctacaccaataaaatggaaagaaggcaaaggcattcctaatggcgttgctcaggagaagaaaggaaacaagcgatcccatgctgaagagagcttcttcacctggttcagtgaagtcaataaaaaagatgatagcgatgatgatgaaaatgaggttctggagattcaggatgaggttgctgaaataatcaaggatgacttgtggccaaaccctttaacttattttaccaatgaacctgatgaagaagattttgagggtgatgaaggtggtgatgagggggaggactctgaagatgaaggtgatgaggaggaagaggaagacgacgaagatgaagatgacaaatgaactgttaatggacctcatatttgatttgatttctcttcttcaatgtttcaattatcatagttggtatctgtaaagaagcttaatattgcagataaaatcgaattatatatagtggtgactgctttttttctaaaaaaaaaaaaaaaaaaaaaaaaa

SEQ ID NO: 23 - protein, 261 aa, Lycopersicon esculentum
MVVDKGKKQKVEEESYIDEKLIFSIEKLQEIQDDLDKINEKASEEVLEIEQKYNKIRKPVYDKRNDIINSISDFWLTAFLSHPVLGDLLTEEDQKIFKFLSSIEVEDSKDVKFGYSITFNFKPNPFFENSKLSKTYTFLEDGPTKITATPIKWKEGKGIPNGVAQEKKGNKRSHAEESFFTWFSEVNKKDDSDDDENEVLEIQDEVAEIIKDDLWPNPLTYFTNEPDEEDFEGDEGGDEGEDSEDEGDEEEEEDDEDEDDK

SEQ ID NO: 24 - DNA, 1557 bp, Arabidopsis thaliana
gtccctagtctcttctgcttcttcttcttcaaaatctctctcttcaccaaatcctcagaagatgagcaacgacaaggatagcttcaacgtctccgatcttactgctgctcttaaggacgaggatcgagctggccttgtcaatgctctaaagaacaagctgcagaatctggctggtcagcgttctgatgtgctcgagaatctgactcccaatgtgagaaagcgcgttgatgccttgagggatatacagagccaacatgatgaactagaggcaaaattccgtgaggagagagctattcttgaagccaagtatcaaacgctgtatcagcctttgtatgtcaagcgttatgagattgtgaatggcactactgaagttgaactggctccagaggatgataccaaggtggaccaaggagaggagaaaactgcagaagagaaaggagttccaagtttctggctgacagctctgaaaaataacgatgttatttccgaggaggtcacagagcgtgatgaaggggctctcaaatatcttaaagatattaagtggtgcaagattgaagagcctaaaggattcaaacttgagtttttctttgacacgaatccgtattttaagaacactgtcttgacaaagtcttatcatatgattgatgaagatgagccactgcttgagaaggctatggggacagaaattgattggtatcctggaaagtgtctaactcagaagattctcaagaagaagcctaagaaaggttcaaagaatactaaaccaatcaccaaactcgaagattgtgaaagcttcttcaacttctttagtcctccagaagttccggatgaagatgaagatatcgacgaggaaagagctgaggatcttcaaaacctgatggaacaagattatgacatcggatctactattcgggaaaagattattcctcgtgctgtctcatggtttactggtgaggctatggaagcagaggattttgaaatagatgacgatgaggaagatgacattgatgaggatgaagatgaggaagacgaagaggatgaggaggacgatgatgatgaggatgaagaagaaagcaagaccaaaaagaagccatcaatcggcaacaagaagggagggagatctcagatagttggtgaaggtaaacaagatgagaggccacccgaatgcaagcaacagtaatcttttactacgctctaccagacataaaaggattgcgtgaaaatataattcaggtcattctctgttcatcaagaatgaggattgagaaaaggttttgggatttttaaaagtgaaattcatcttgtaggagtttcgttcgtttttctattggtgtgtttattttctctaaagcactttaataatataccttggtatttaatttatgaatcaagcatcatcatccctagtctctgcattcactacttcatcccctacctaaactttgtcgacgaaagagattttaataaccatttagatagtaatgggtagtgggaatgatcattattcttttgttcaccgtcctttgattttcaatggtaaccattttgttgtgtaag

SEQ ID NO: 25 - protein, 372 aa, Arabidopsis thaliana
MSNDKDSFNVSDLTAALKDEDRAGLVNALKNKLQNLAGQRSDVLENLTPNVRKRVDALRDIQSQHDELEAKFREERAILEAKYQTLYQPLYVKRYEIVNGTTEVELAPEDDTKVDQGEEKTAEEKGVPSFWLTALKNNDVISEEVTERDEGALKYLKDIKWCKIEEPKGFKLEFFFDTNPYFKNTVLTKSYHMIDEDEPLLEKAMGTEIDWYPGKCLTQKILKKKPKKGSKNTKPITKLEDCESFFNFFSPPEVPDEDEDIDEERAEDLQNLMEQDYDIGSTIREKIIPRAVSWFTGEAMEAEDFEIDDDEEDDIDEDEDEEDEEDEEDDDDEDEEESKTKKKPSIGNKKGGRSQIVGEGKQDERPPECKQQ

SEQ ID NO: 26 - DNA, 1575 bp, Arabidopsis thaliana
gtgtcttatttcggtctggtcattttctcaaagcccttttagttatttatatatatattctctgtctcgtatttgtccccaaaaatctagggttttaaggtttcttatccttcctcttcctccgccagattcttttcttgcgaagatgagcaacgacaaggacagcatgaacatgtccgatctctccaccgctcttaacgaggaggatcgtgccgggcttgttaatgctcttaagaacaagttgcagaatttggctggacaacactctgatgtccttgaaaacttgactccaccagtcaggaagcgtgtcgagtttctaagagagattcagaaccaatatgatgagatggaagcaaaattctttgaggagagagcagctcttgaagctaagtatcaaaagttatatcagcctttatataccaagcgatatgagattgtgaatggtgtggtcgaagttgaaggtgcagctgaagaagtaaaatccgaacaaggagaagataaatcagctgaagagaaaggagtaccagatttctggcttattgcattgaagaacaatgaaattactgcggaagagataactgagcgagatgaaggggctctcaagtatctcaaagatatcaagtggagtagggttgaagaaccaaaagggttcaagcttgagtttttctttgatcagaatccttacttcaagaacactgtcttgaccaagacatatcacatgattgatgaagatgagcctatccttgagaaggccctcgggacggagattgagtggtatcctggaaagtgtttgacacagaagattctaaaaaagaagccaaagaaaggatccaaaaacacaaagccgatcactaagactgaggactgtgagagtttcttcaactttttcagtccacctcaagttcctgacgatgatgaggatcttgatgatgacatggctgatgaactccaaggacaaatggagcatgattatgatatcggttcaacaatcaaagagaaaatcatctcgcatgctgtgtcatggttcactggtgaagctgttgaggcagatgaccttgatattgaggacgacgatgatgagattgatgaagatgatgatgaagaggacgaggaagatgatgaggatgacgaggaggaggatgatgaggatgatgacgaggaggaagaagcagatcaaggaaagaagagcaaaaagaagtcatcagctgggcacaagaaggctggaagaagtcaacttgcggaaggtcaagcaggtgagaggccaccggaatgtaagcagcagtgaagaagtgaagaatcttggcttagttatgatgaagaagaagagtgaagagtgtctttgagccgaggttgtgtttctttaatttgcagagtcatggtccggtttattatatatcagttttgggtgattggtttgctatttaaaaaaaaaaaatgggttctttggtttggtttgtgtctcttgatttttccttttgtaatgatcttatgaatttgtttcgagttaatgtcgttctctggtcagatttcgaattcaattctatttatcctccctcgttaatgagagaatttgtg

SEQ ID NO: 27 - protein, 379 aa, Arabidopsis thaliana
MSNDKDSMNMSDLSTALNEEDRAGLVNALKNKLQNLAGQHSDVLENLTPPVRKRVEFLREIQNQYDEMEAKFFEERAALEAKYQKLYQPLYTKRYEIVNGVVEVEGAAEEVKSEQGEDKSAEEKGVPDFWLIALKNNEITAEEITERDEGALKYLKDIKWSRVEEPKGFKLEFFFDQNPYFKNTVLTKTYHMIDEDEPILEKALGTEIEWYPGKCLTQKILKKKPKKGSKNTKPITKTEDCESFFNFFSPPQVPDDDEDLDDDMADELQGQMEHDYDIGSTIKEKIISHAVSWFTGEAVEADDLDIEDDDDEIDEDDDEEDEEDDEDDEEEDDEDDDEEEEADQGKKSKKKSSAGHKKAGRSQLAEGQAGERPPECKQQ

SEQ ID NO: 28 - DNA, 1624 bp, Arabidopsis thaliana
gccacccagaaaaaaccctcaagtcttcttcttcttcctcaatctctccacctcttttcaaaccttcttcacactctctctcaatcaatcctttttcttctcaaatctttcagttttgatctctaaatttccagaaaatgagcaacgataaggacagtttcaatgtcagcgatctcacttctgctcttaaagatgaggatcgagctggtcttgtcaacgctcttaagaacaagctccagaatctagctggacaacattctgatgtgctcgagaatctgactcctaaaattagaaggcgtgttgaggttttgcgggagattcagggcaaacatgatgaaatagagacaaaattccgcgaggagagagctgctcttgaagccaagtatcaaaagttatatcagcctttgtataacaagcgttatgagattgtgaatggagctactgaagttgaaggggctccagaggatgctaagatggaccaaggagacgagaaaactgcagaagagaaaggagtccctagtttctggctgactgctctgaaaaataatgatgttatatctgaagagatcacagagcgtgatgaaggagcccttatatatcttaaagatatcaagtggtgcaagattgaagaaccaaagggattcaaacttgagtttttcttcgaccagaatccttacttcaaaaacaccctattaacaaaggcgtatcatatgattgatgaagatgagcctctgcttgagaaggctattgggacagagattgattggtatcctggaaaatgcttaactcagaagattcttaagaagaagcctaagaaaggtgcaaagaatgccaagccaattaccaaaactgaagattgtgaaagcttcttcaacttcttcaatcctccccaagttcctgatgatgatgaagacattgacgaagaaagagccgaggaacttcagaatctgatggaacaagattatgacattggttctacaatccgggagaagatcatacctcatgctgtctcatggtttactggtgaggctattgagggagaggagtttgaaatagacaatgacgatgaagatgatatcgatgaggatgaagatgaggatgaagaagatgaagacgaagatgaggaagaagacgacgaagatgaggaggaagaagtaagcaagaccaaaaagaagccatcagtcttacacaagaaaggagggagacctcaggttaccgatgatcaacaaggagagaggcctcctgaatgcaaacaacagtaaacaaaatcgaaaagtctaaacgaaaaccagtaaaagaaaaacaaatgttttgggttttgagtgaagtttcatggcctagttttttgcttccatgtaaggcaaaatgttttgaagactgctcataggaatgttgctgtaggcaaaagagtgagtttctccatgtggagatacttgataaattatttttggtgcatttgttttttttttttttaatcactaagttgaattttggtgtgttcgtcaaaattatatctttttaccacttgaattaagtctcttttggtttctttaatttaaaaataaataaatcttatcattgttttttttgtgtggacataagtgtattattcttattgtaaacc

SEQ ID NO: 29 - protein, 374 aa, Arabidopsis thaliana
MSNDKDSFNVSDLTSALKDEDRAGLVNALKNKLQNLAGQHSDVLENLTPKIRRRVEVLREIQGKHDEIETKFREERAALEAKYQKLYQPLYNKRYEIVNGATEVEGAPEDAKMDQGDEKTAEEKGVPSFWLTALKNNDVISEEITERDEGALIYLKDIKWCKIEEPKGFKLEFFFDQNPYFKNTLLTKAYHMIDEDEPLLEKAIGTEIDWYPGKCLTQKILKKKPKKGAKNAKPITKTEDCESFFNFFNPPQVPDDDEDIDEERAEELQNLMEQDYDIGSTIREKIIPHAVSWFTGEAIEGEEFEIDNDDEDDIDEDEDEDEEDEDEDEEEDDEDEEEEVSKTKKKPSVLHKKGGRPQVTDDQQGERPPECKQQ

SEQ ID NO: 30 - DNA, 990 bp, Arabidopsis thaliana
atgagcaacgaagaaaacatcaaatctgataataagagcggcgattcctctgatctccctaccattcccgccttagatattggggcagaggaatgtgatcttcttgcagagcttaaggcaagtcacttcaaattgttgataaaaattcacacaaacctaaccttaaagcgaccatttgatgtgaaaaaactctcacctaaagttaccaaacgtgttctgttcctcaaagacattcaggttacacacgatgaactcgaagagaagtttcttgctgagaaatctgcattggaggcaacatatgataatctctacaagccgctttttgctaagaggtatgaaattgtgaatggtgtggtcgaagctgaagcagagaaagaaggagttcccaatttctggttgattgcaatgaaaaccaatgaaatgctcgcaaatgagataacggaaagagatgaggcagcattgaagtatcttaaggacatcagatcttgcagagttgaagacacttcaagaaatttcaagctggagtttctctttgattctaatctttacttcaagaactcggttctgtctaaaacttaccatgtgaacgatgaagatggtcctgttcttgagaaagtgattggaacggacatagaatggtttccaggtaaatgtttgactcataaggttgttgtgaagaagaaaacaaagaaagggccaaagaaggtcaacaacatccccatgaccaaaacagaaaactgcgagagtttcttcaatttcttcaagccacctgagattcctgagattgatgaagttgacgattacgatgattttgataccattatgacggaagaactacaaaacctgatggaccaagactatgacattgctgtgacaatccgagataaactgatccctcatgcagtttcatggtttacgggagaggctcttgttgatgaagacgattctgatgataatgatgatgatgataatgatgagaagagtgactaa

SEQ ID NO: 31 - protein, 329 aa, Arabidopsis thaliana
MSNEENIKSDNKSGDSSDLPTIPALDIGAEECDLLAELKASHFKLLIKIHTNLTLKRPFDVKKLSPKVTKRVLFLKDIQVTHDELEEKFLAEKSALEATYDNLYKPLFAKRYEIVNGVVEAEAEKEGVPNFWLIAMKTNEMLANEITERDEAALKYLKDIRSCRVEDTSRNFKLEFLFDSNLYFKNSVLSKTYHVNDEDGPVLEKVIGTDIEWFPGKCLTHKVVVKKKTKKGPKKVNNIPMTKTENCESFFNFFKPPEIPEIDEVDDYDDFDTIMTEELQNLMDQDYDIAVTIRDKLIPHAVSWFTGEALVDEDDSDDNDDDDNDEKSD

SEQ ID NO: 32 - protein, 199 aa, Arabidopsis thaliana
IEKLQEIQDDLEKINEKASDEVLEVEQKYNVIRKPVYDKRNEVIQSIPGFWMTAFLSHPALGDLLTEEDQKIFKYLNSLEVEDAKDVKSGYSITFHFTSNPFFEDAKLTKTFTFLEEGTTKITATPIKWKEGKGLPNGVNHDDKKGNKRALPEESFFTWFTDAQHKEDAGDEIHDEVADIIKEDLWSNPLTYFNNDADE

SEQ ID NO: 33 - protein, 6 aa, Artificial Sequence
  NAP1-like protein domain
  VARIANT (1)..(1): Xaa is Thr or Ser
  VARIANT (4)..(4): Xaa is Asn, Ser, Glu, Asp or Thr
  VARIANT (5)..(5): Xaa is Phe or Trp
  VARIANT (6)..(6): Xaa is Leu or Phe
XFFXXX

SEQ ID NO: 34 - protein, 10 aa, Artificial Sequence
  conserved amino acid sequence of NAP1-like protein domain
SIEKLQEIQD

SEQ ID NO: 35 - DNA, 1597 bp, Pisum sativum
ggcacgaggattagagagccagttccagacagtacaatcaatcaaaaccctccccttcttccggctaggttttgcttttttgctgtcatcttcttcttcctccatttctcacttctcaatgacgaacaacaaggaagctttcaacatctcagatctcagttccgctctcaatgaagaggatcgggctgacctggtcaacgctctcaagagtaagatacagagtcttgctgggcaacactctgatgttctggagagtctgtctcctgttgtcaggaagcgtgtggaggttctcagagagattcagggtgaacatgatgaattggaggcaaagtttttggaagagagagctgctcttgaagccaaataccaaattttgtatcaaccattgtacactaagcgttatgatattgtgaatggtgttgctgaagtggtaggggtacgagttgaaactgctgttgcagaagaggataaagagaaaggagtgccttcattttggcttaatgctatgaaaaacaatgatgtcggaggtgaagaaattacagagcgcgatgaaggcgctctcaagtttctcaaagatatcaagtggacaaggatcgaagaacctaaaggattcaaacttgagtttttcttcgattccaatccctatttttcaaactcggtgttgaccaaaatctatcatatggttgatgaggatgagcctatactggagaaggctattgggactgaaattcagtggcttccaggaaaatgcctgacccaaaaggttttgaagaaaaagcccaagaagggtgcaaagaatgctaaaccaattaccaaaactgaaacctgtgaaagtttctttaactttttcaatccaccagaagtccctgaagatgatgaagacattgatgaagatatggctgaggaacttcagaatcagatggaacaagactatgacattgggtcaacaataagagataagatcatccccatgtcgtggtttactggggaggctgctcagggagaggagtttggagacctggatgatgaagatgaggatgaggacgatgatgctgaggaggatgatgaagaggaggatgaggacgaagatgatgatgatgaagaagaggaagagactaagactaaaaagaagtcatctgctagtaagaagaggatcggaattgcgcagcttggcgatggtcagcagggtgaaagaccaccagagtgcaagcagcagtagtttatttattcagagtatgatgctactgaaagttgctttggggtcctagcgcctgatgaaaaagagttctcaatttcatgtggttttcatggtccttaattcattttcctcccctagttttattttagtctgaatttattgagtctcttgcccctttttgtccctctccttttggagagatggtgttatatagtcagtggtggtggtgtgatttattggtacttcaagtttaggtctccttcctagatacttaaagttgtgcttgattattaccaatatttttggtatactttgattagcaaaacgttgctacaagttttcgcttgagaagaaatattgtaatgattttttcttctaaatgcatgttacaattttatt

SEQ ID NO: 36 - protein, 366 aa, Pisum sativum
MTNNKEAFNISDLSSALNEEDRADLVNALKSKIQSLAGQHSDVLESLSPVVRKRVEVLREIQGEHDELEAKFLEERAALEAKYQILYQPLYTKRYDIVNGVAEVVGVRVETAVAEEDKEKGVPSFWLNAMKNNDVGGEEITERDEGALKFLKDIKWTRIEEPKGFKLEFFFDSNPYFSNSVLTKIYHMVDEDEPILEKAIGTEIQWLPGKCLTQKVLKKKPKKGAKNAKPITKTETCESFFNFFNPPEVPEDDEDIDEDMAEELQNQMEQDYDIGSTIRDKIIPMSWFTGEAAQGEEFGDLDDEDEDEDDDAEEDDEEEDEDEDDDDEEEEETKTKKKSSASKKRIGIAQLGDGQQGERPPECKQQ

SEQ ID NO: 37 - DNA, 1442 bp, Glycine max
cttctctctagggttttagcactctctctctctctcgttttcgttcttcctttctgcctctctcagtcacacaccttctcgatgaccaacgacaacatcgccgtcacagatctcacttctgccctcaatgaagagaatcgcgccgacctagtcaatgctctcaagagcaagattcagagtctggctggggcgcattctgatgttctagagactctatccccgaatgtcaggaagcgtgttgaatctcttagagaaattcagggtaaacatgatgaactagaggcagacttcttgaaggagagagaagctcttgaagcaaagtaccaaaaactgtatcagccattgtacacaaagcgctatgaaattgtaaatggtgttactgaagtggaaggggcagcaaatgaatcaacagatgaatcagaagagaataaagagaaaggagtgccttctttttggctcaatgcaatggaaaataatgatgtgttagctgaagagatttcagagcgtgatgaaggtgctctcaagtttcttaaagatatcaagtggagcaggatagaaaatcctaaagggttcaagcttgatttcttctttgataccaatccttacttttcaaataccgtcttgacaaaaacatatcatatgattgatgaggatgaacctatattggagaaagcaattgggacggaaattgaatggtacccgggaaaatgcttgactcagaaggttttgaagaagaagcctaagaagggttcaaagaatgctaaaccaattaccaaaactgaaagctgtgaaagcttcttcaattttttcaaaccaccagaagtccctgaagatgatgctgacattgatgaagatttggctgaagaacttcagaatcagatggaacaagattatgacattgggtcaacattaagagataaaattatccctcatgctgtatcatggtttactggggaggccgctcagggagatgagtttgaagacctggaggatgatgaggacgaagaggaagatgaggacgaagatgaggacgaagaggatgacgaggacgaagacgatgaagaggaggatgacactaagactaaaaagaagaagagtggtaaggcacaggctggtgatggtgatggtgagcgacctccagagtgcaagcagcagtaattgtttgtttcttcggagtatcatgtggctgatgggtgtttttgaggtcctatggtgcctgacgggaaagtgggtttcaatttcatgcaatttttcatagtccttgattcattttcctccctagatccgatagtctgaatttattgagtcaatttctcctttttcccatattttgggagaatgtggttatatatttgtagtcagggatgctgtgatttgttactgttggaatttgtacgtcattccagacacttcacatatattataggttgtgctttgttact

SEQ ID NO: 38 - protein, 358 aa, Glycine max
MTNDNIAVTDLTSALNEENRADLVNALKSKIQSLAGAHSDVLETLSPNVRKRVESLREIQGKHDELEADFLKEREALEAKYQKLYQPLYTKRYEIVNGVTEVEGAANESTDESEENKEKGVPSFWLNAMENNDVLAEEISERDEGALKFLKDIKWSRIENPKGFKLDFFFDTNPYFSNTVLTKTYHMIDEDEPILEKAIGTEIEWYPGKCLTQKVLKKKPKKGSKNAKPITKTESCESFFNFFKPPEVPEDDADIDEDLAEELQNQMEQDYDIGSTLRDKIIPHAVSWFTGEAAQGDEFEDLEDDEDEEEDEDEDEDEEDDEDEDDEEEDDTKTKKKKSGKAQAGDGDGERPPECKQQ

SEQ ID NO: 39 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 40 - DNA, 739 bp, Arabidopsis thaliana
ccatagatctcaagtctctctctcttagtgaataaattagggttcgttgattctctgttcttaagctcagtaatcgaggagaagaagaaaagggaagatcgggaattgggaaactgagaagtcaaaaaggcaaatgcgagtggaggagattgagttttagaattccaatgtcttgggctgctcctgatgatatcttcttctccacttctcttgctgcttacctagacaagaaacttcttgtgttgcttcgtgatggtaggaaactgatgggtctacttcggtcctttgatcaatttgctaatgctgttttagaagaagcttatgaaagagtcattgtgggtgatctctactgtgatattcccttaggtctatacattatccgtggagaaaatgttgtcttgattggtgaattggacgtggaaaaagaagagcttccagctcatatggttcaggttccagaagcagagataaaaagggctcagaaagcagagaaggaagaaatgcttttaaagggcacaatgcggaaaagaatggagttccttgatctcgattagggcattttcctatgtgttgcagcattgtagaaactagaagatctcaagatggaggatacagaagatccttaaacgtcataatgttagttgatgtgtgtatgtgtggatgacattgatgaatcctcagaacttagtcgttgcagatcctctgctctgtttatggaatgaaattgttgagcctgttc

SEQ ID NO: 41 - protein, 128 aa, Arabidopsis thaliana
MSWAAPDDIFFSTSLAAYLDKKLLVLLRDGRKLMGLLRSFDQFANAVLEEAYERVIVGDLYCDIPLGLYIIRGENVVLIGELDVEKEELPAHMVQVPEAEIKRAQKAEKEEMLLKGTMRKRMEFLDLD

SEQ ID NO: 42 - DNA, 922 bp, Arabidopsis thaliana
gacggatttgctcgctagttttctcttcgaattttccacaaacaaattttctcagccaaagttcgatcggatctgggttttatatttttttgaagaacccgtgtccgtcttcgatcaggtgtcgaaagtctcaatcttttttaatcactttatcaatttaaaccctttggtcaaaaccctaatttagatttctctttccgtcttcactttttttttttcctgtcaaagttcgcgttcaatagccaaatcttatctcttcagctggaatctgacgaacattattatcatcggtagtgttctatagaaagaccgaaagttttcttcaatttcaaagtcagtggcgatgtcgtgggctggtcctgaagaaatttatctttcaacatcactcgctagttatctcgatagaaaactacttgtgcttcttagagatggtagaaagctaatgggaacactccgttcctttgatcaattcgccaatgcggttctagaaggtgcgtgtgagagggtaattgttggtgaacaatactgtgacattcctttaggcctctatgtaatccgtggagagaatgttgttttgattggtgagctggacacggagagagaagagcttcctccacatatgattcgcgtctcagaggcagagattaaaagggcacaaaaggtggagagggaagcgagtgagctgagaggaacaatgaggaagagaatggagtttcttgactttgattaaaccagattgtatccccattcattattggcttgatgctctgctttggctcgcaagttttatgatgagcctttttggtgtgttgacttaggggatcgacgcaattcttgtgtttcattttggatgaatatgacaataaatctgtgtacttttgtctttggatctatttacctttttaagaaaaaaatgttaagc

SEQ ID NO: 43 - protein, 128 aa, Arabidopsis thaliana
MSWAGPEEIYLSTSLASYLDRKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 44 - DNA, 282 bp, Arabidopsis thaliana
atgttgttcttttcttacttcaaggatttggttggacaagaagtgacggttgagctgaagaatgatttagccataagaggaactcttcactcagttgatcagtatctgaatatcaagctcgagaacactagggttgttgaccaggacaagtaccctcacatgctttcagtgagaaactgtttcatcagaggatctgtggtaaggtacgtgcagttacctaaagatggagtcgatgttgatttgcttcacgacgcagctagaagagaagctaggggtggctga

SEQ ID NO: 45 - protein, 93 aa, Arabidopsis thaliana
MLFFSYFKDLVGQEVTVELKNDLAIRGTLHSVDQYLNIKLENTRVVDQDKYPHMLSVRNCFIRGSVVRYVQLPKDGVDVDLLHDAARREARGG

SEQ ID NO: 46 - DNA, 652 bp, Arabidopsis thaliana
cgagagcactacaatttcaaaaccctcggagaagttataatcagaaaatgtcagtcgaggaagacgccaccgttagagagccactcgatctgattcggttgagtatcgaagagaggatctatgtcaagctccgatctgaccgtgaactccgcggcaagcttcacgcttttgatcagcatttgaatatgattctgggtgatgttgaagaggttattacgactatagaaatcgacgacgagacatatgaagagattgttcggacaacgaagcgaacggtaccgtttctattcgtgagaggagatggagtgatattggtgtcaccgcctttgaggacgacctaaatgttcttgtgtactgggatcggagttaacaaatctggcgctgagtaaaagcacttttttctgattacttggcttttgaatttgtaattgtgtggtatgtttttctttgttgtcaaacattgaaaccgaatgtagcattcgaatcttggtaatgggtgcctcgttatagtagaatcagtgtaacatacttcgtattgtgactttcttaccgtttacgatcggatttagtttcgttttctggtttggtgtagttttctctaaagatttgtatacttcctcaaactcattgatttcgagctctattatgaata

SEQ ID NO: 47 - protein, 97 aa, Arabidopsis thaliana
MSVEEDATVREPLDLIRLSIEERIYVKLRSDRELRGKLHAFDQHLNMILGDVEEVITTIEIDDETYEEIVRTTKRTVPFLFVRGDGVILVSPPLRTT

SEQ ID NO: 48 - DNA, 297 bp, Arabidopsis thaliana
atgtccggcgaggaagaagccaccgtgagggagccactagatctgattaggctgagtctcgacgagagaatctatgtcaagctccggtcagaccgcgaacttcgcggcaagcttcacgcgtttgatcagcatttgaatatgattctgggtgatgttgaagaaactatcactacagtagaaatcgatgacgagacatatgaagagattgttcggactacaaagcggacgattgagtttctattcgtgagaggagatggagtgatattggtgtctccaccgctgaggacagcagcctga

SEQ ID NO: 49 - protein, 98 aa, Arabidopsis thaliana
MSGEEEATVREPLDLIRLSLDERIYVKLRSDRELRGKLHAFDQHLNMILGDVEETITTVEIDDETYEEIVRTTKRTIEFLFVRGDGVILVSPPLRTAA

SEQ ID NO: 50 - DNA, 865 bp, Arabidopsis thaliana
aaaactaaaagaccaccgattcattagaaatccatccctctcactgtcaaaacccgagaagcagaaaaaagcaaaaaacagatttcgaagtttcgacgcctctctattcttcgatctctttcatatttgaatcgttcaccttcttgccgatcttcggagtatattacaaggttcttaacggatctctaaatcttctgatttaagaagatgcttcctctatcgctgcttaaaactgctcaagggcatcctatgctcgtggagcttaagaatggagagacatacaatgggcatttggtgaattgtgatacttggatgaacatccatctgcgtgaagtcatatgtacatcaaaggacggagatagattttggaggatgccggaatgttatatccgtggtaacacaatcaagtaccttcgagttccggatgaggtgattgataaagtacaggaggagaagacacgcacagatagaaaaccaccaggtgttggacgtggaagaggacgtggtgtggatgatggaggagccagaggcagaggcagaggaacttcaatggggaagatgggtggcaacagaggagcaggtcgcggccgtggttgatgcaacaagttttaaagactcgctgccaaatctgctaacttcccattgtggagaaaaccaaaagttacataagaagttggtctgttgttggttttctattaagtatgtaagggatagggagtgtgtttttcgattctccttgtgatcttttcgaaaaatgaaatttgtcttttgcctttttgtggtatatgtgaaattccaattgttttcatttgcgcttaaaaatgaatctttcaggtcttgaatttatataattgttagagaattt

SEQ ID NO: 51 - protein, 129 aa, Arabidopsis thaliana
MLPLSLLKTAQGHPMLVELKNGETYNGHLVNCDTWMNIHLREVICTSKDGDRFWRMPECYIRGNTIKYLRVPDEVIDKVQEEKTRTDRKPPGVGRGRGRGVDDGGARGRGRGTSMGKMGGNRGAGRGRG

SEQ ID NO: 52 - DNA, 267 bp, Arabidopsis thaliana
atggcgaacaatccttcacagcttcttccttcagagctaatcgataggtgtatagggtctaagatttgggtgataatgaaaggagataaggagctcgttggtattctcaaaggattcgatgtttatgtcaacatggttcttgaagatgtcaccgaatatgagattacggcagaaggaagacgggtcacaaagcttgatcagattctactcaatggcaacaacatcgccattctggtgccaggtgggtctcccgaagatggagaatga

SEQ ID NO: 53 - protein, 88 aa, Arabidopsis thaliana
MANNPSQLLPSELIDRCIGSKIWVIMKGDKELVGILKGFDVYVNMVLEDVTEYEITAEGRRVTKLDQILLNGNNIAILVPGGSPEDGE

SEQ ID NO: 54 - DNA, 625 bp, Arabidopsis thaliana
aaataataaaagcccttaggaccgattcgttatttcttcgctctctctttctctctgtgtctcgtactcgagtaggtctcagttacgtaaaggatcgagcttaaaagatgagtggagttgaagagaaagtttctggaacgacaaagacacctgcagatttcctcaaatccatccgtgggagacccgttgttgtcaagctcaattctggtgttgattatcgaggcactcttacttgtcttgatggatatatgaacatagcaatggagcagacggaggagtatgtaaacgggcagctcaagaacaaatatggtgacgcctttatccgtggaaacaacgttctttacatcagtacagtaaacatgactgtagcagacggagcctaggcccatcatgatcatcaacaacaacaacagtggtcatgttatggctgccatttttgttgtcttcttctacctcatattaaaagagtagtagacatgtaccaagattgtcatcctatgttcttcagtagatttttgggatacagacatcacttttttcttagtaatatgatactcttccatgtgaccccagataaagaagaaaaattattaatttatggcttgatacaatcatacaagcaaac

SEQ ID NO: 55 - protein, 91 aa, Arabidopsis thaliana
MSGVEEKVSGTTKTPADFLKSIRGRPVVVKLNSGVDYRGTLTCLDGYMNIAMEQTEEYVNGQLKNKYGDAFIRGNNVLYISTVNMTVADGA

SEQ ID NO: 56 - DNA, 781 bp, Arabidopsis thaliana
gctctgttcggctgcttcatcgagcggaagtctctagccaattaccgtttgttcgtggactcgagatattgtggtttcttagcaaagaagatgagtggagttggagagaaagcttctggaacaactaagacacctgctgatttcttgaaatctatccgtggtaaaccagttgttgtcaagctcaactctggtgttgattatcgaggcattcttacttgtcttgatggatatatgaacatcgcaatggagcaaaccgaagagtatgtaaatggccagctgaagaacacatatggcgacgcttttgtccgtggcaacaatgttctttacatcagcacaacaaaggggacattgtcagatggagcatagctctctttcatcaccatgaatgttcatcttcttctctacctctggcatatgacaaatgtaggatttgtagcaaccagagtttatcaccactgcatgaattcgacatgtctttttcttccgcaactcagtttgtgtctaaatcatctccaaaattctgagatatagctagatttttatttgttatgaaattttttttaatcactgttggtctttggagcctaattatcgtgttttgatgacgcaatcactgcgtcacaatctgatgtcatcttaacaatcattaatgtattttttttttcttttctcgtaatattcttaattattcttcgacagcaaaggtttaaaaactccttatttcaatcattaatgtatttatgatttgatcgaataacaataatatagcttattttgttct

SEQ ID NO: 57 - protein, 91 aa, Arabidopsis thaliana
MSGVGEKASGTTKTPADFLKSIRGKPVVVKLNSGVDYRGILTCLDGYMNIAMEQTEEYVNGQLKNTYGDAFVRGNNVLYISTTKGTLSDGA

SEQ ID NO: 58 - DNA, 599 bp, Arabidopsis thaliana
gtcactaggaagctgcgactatttgactgactctgatttcacgcgactccttgtgagattctccgattgcttcgcctgagtttctgggttaactctccacgccgtcactttgatctttgcttttccgatctttagggtttttgtttagggaattgtcgaagactctgctctaacatgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagttcgttcgagatcatgatgatcctttgaagactacggatcagacaagacgccttggtttgattgtttgccgtggaacagcggtgatgcttgtctcaccaaccgatggcaccgaagaaatcgctaacccgttcgttactgcagaggctgtctaaagactttcttctcaaagaatatgtctctctattagtttaacttggcgatttagagagtatttcatctaactctctggtgtgatgttggaaacatatatgttcaatttaaacaatttggaacatca

SEQ ID NO: 59 - protein, 99 aa, Arabidopsis thaliana
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 60 - DNA, 650 bp, Arabidopsis thaliana
aaaaacacacgccggagagttttctaagaacaacagtgacgaaaaggtttttagggtttctttaccaatcagaatctccgccaagtaacgattttcagattccgaagcagcaaagttcaaataatttccgaactgtaacatggcggcaactactggacttgagactctcgtcgatcagattatttcggtgattacaaatgacggacgcaacattgtgggagttcttaaaggttttgaccaggctacaaatataatccttgatgaatctcatgaacgtgtgttttccacaaaggaaggagtacaacaacatgtgttgggtttgtacatcatcagaggggacaacataggtgttatcggggagctggacgaggagcttgatgctagtctggatttttcgaagctgagagcccatccgttgaaacccgtagtgcattgattgaatatagttatggtgagaaaatctaattctctcattcaaagcctaaaaacaaagagaagatttgattgtaaacaatttggatagtttgttttgatgtctggagttgtcttatttgtgtatcctaaggacaaaagctatatgatattttatgtcttaaacgttttggtcggaaacttaaatcatacaatcttttggacggacctaggtttgc

SEQ ID NO: 61 - protein, 98 aa, Arabidopsis thaliana
MAATTGLETLVDQIISVITNDGRNIVGVLKGFDQATNIILDESHERVFSTKEGVQQHVLGLYIIRGDNIGVIGELDEELDASLDFSKLRAHPLKPVVH

SEQ ID NO: 62 - DNA, 387 bp, Medicago truncatula
atgtcttgggctgcacctgatgagcttttactctctacttctcttgctacatatcttgacaaaaaacttcttgtcctgttgcgagatgggcggaaacttttgggtttattacgctcatttgatcaatttgctaatgtcgttctagaaggtgcgtgtgaacgagtgattgtcggtgatctttattgtgatgtccctttaggcctttatgtaattcgtggggagaatgttgtcttaattggagagctggacttgggaaaggaggagcttccaccacatatgacatgtgtgtcagaggctgacataagaaaggctcaaaaagcagaacgcgatgctagtgatctgaagggaactatgaggaaaaggatggaattccttgattttgactaa

SEQ ID NO: 63 - protein, 128 aa, Medicago truncatula
MSWAAPDELLLSTSLATYLDKKLLVLLRDGRKLLGLLRSFDQFANVVLEGACERVIVGDLYCDVPLGLYVIRGENVVLIGELDLGKEELPPHMTCVSEADIRKAQKAERDASDLKGTMRKRMEFLDFD

SEQ ID NO: 64 - DNA, 387 bp, Populus trichocarpa
atgtcttgggcaggcccagaagatatctacctctctacttctcttgccaactatcttgataagaagcttcttgtgctcctacgagatggccgaaagctcatgggattacttcgttcttttgatcaatttgccaatgctgtccttgaaggtgcatgtgaaagagttattgttggtgacctttattgcgacatccacttgggtctatatgtgattcgtggggagaatgttgtcttaattggagagctggatttggagagggaggagcttccaccacatatgactcgtgtttcagaagcagagattagaagggcgcagaaagcagaaagggaggcaacagatctaaaaggtacaatgaggaaaagaatggagttccttgatttggactag

SEQ ID NO: 65 - protein, 128 aa, Populus trichocarpa
MSWAGPEDIYLSTSLANYLDKKLLVLLRDGRKLMGLLRSFDQFANAVLEGACERVIVGDLYCDIHLGLYVIRGENVVLIGELDLEREELPPHMTRVSEAEIRRAQKAEREATDLKGTMRKRMEFLDLD

SEQ ID NO: 66 - DNA, 824 bp, Oryza sativa
gcgtcaacctcacacttgacgatagttcctttcatcaatcacccagctttactcctcttctccccccgccccgcttcaccaatcaatccaaaccctagagcaaatcccctccctcccttgccggaatcgctcgcaagctccaggcagcccccacaccagtccgcggcggatcagggggcggggcgatctctagcgccctccgggatttgaagggttccgagcgtcggcgatgtcgtcgtgggccgggcccgacgagatcttcctctccacgtccctggccggcttcttggacaagaaacttattgtcctactacgagatggacggaagctgcttggcacactctgctcatttgatcagtttgcaaatgttgttcttcagggtgcttgtgaacgagtaattgtaggtgaactatattgtgatgttcctcttggtctatatgtgatccggggagagaatgtcgtattaatcggagaattggatcgtgagaaggatgaactccctgctcacatgacttgtgtttcagaggctgaaataagaaaggccgagaaagcagaaagggaagcgagagatctgaaaggttcaatgaggaagaggatggagttcttagactttgattagaatggatttgaccatcttgatagttgctgctcccactatggccgcgagtttttaatggcagcctctgctacatatgtgggctaatgaaagccagatttcgttgtatctcatgctgcttgttcagccagaattcttcaggttggagatttcagtaaacatactcttttacagcggtaatgtacctgtgttcttaaaatttcttcag

SEQ ID NO: 67 - protein, 129 aa, Oryza sativa
MSSWAGPDEIFLSTSLAGFLDKKLIVLLRDGRKLLGTLCSFDQFANVVLQGACERVIVGELYCDVPLGLYVIRGENVVLIGELDREKDELPAHMTCVSEAEIRKAEKAEREARDLKGSMRKRMEFLDFD

SEQ ID NO: 68 - DNA, 579 bp, Oryza sativa
gggtaagctagggtttaggtctcggcgcgcggcggaggggaggaggaggcgatggcggcggcggcggcggcagcggcggctgaggaggagatcgcggtgaaggagccgctggatctgatcaggctcagcctcgacgagcgcatctacgtcaagctcaggtccgaccgcgagctccgcggcaagctccatgcatacgatcaacatttaaacatgattcttggagatgttgaggagatcgtgacaacagttgagattgacgatgagacatatgaagaaattgtgcgcaccacaaaacgcactatccccttcctttttgttcgaggtgatggtgtcattttggtttctccacccctccgaacggcatgaagtatgaaggaagctcctgccgattgtcaaccatgagtaatgtgtattttttaatcaatggcatgtgttatgtgctgaagtgctactatttctgatggattctagttttagcatatgatacaattgtgtaacaatttctgatcgaggtgctagtttctactgtcatgttgaatcaaccttttgttaccagattaatcaactcaatcccgaagc

SEQ ID NO: 69 - protein, 104 aa, Oryza sativa
MAAAAAAAAAEEEIAVKEPLDLIRLSLDERIYVKLRSDRELRGKLHAYDQHLNMILGDVEEIVTTVEIDDETYEEIVRTTKRTIPFLFVRGDGVILVSPPLRTA

SEQ ID NO: 70 - DNA, 954 bp, Oryza sativa
atttgggacacgtgtacataactctttcggtccgggaccctctcttgtttttcttcgttgctcgcgagctcttcccccctcgcctcgcctccccacccaacaagcccgcggcggcgactagggttttgaccccccggaatcccccctcctctcgccgcctccgcctccgccgccgccgccttcctccccgcgccggcgacgatctgctcctcctcccccgccggcatcgctgtttccggatctagcgcaagatgcttccgctctcgctcctcaagaccgcccaggggcatcccatgctcgtggagcttaagaacggcgagacgtacaacgggcacttggtgaactgcgacacgtggatgaacatccacctccgggaggttatttgcacctcaaaggatggtgataagttttggaggatgccagaatgttacatccgtgggaacaccatcaagtatcttcgggttcctgatgaggtgattgacaaggtccaggaagagacttcaaagagcagatcagataggaggccaccaggtgtaggccgcggaagaggaagaggtgatataggtactaagcctggaggcagaggcattgggcgtggccaggatgatggtggcagcaaaggcggtggtggccgtggaaggggaggaattggaggtaaaggtggcatcaaaggtgggggccgcggacgtgggtgagagggaaggtcacttgtgggaatgccgcttttttaaggctttgtgtcacatagattgctttaggagggtgaagaatggactggtggagtaagcattgctttgctttatcattttgtggtatgaccgaaaaatgtttcatgggttcagtagttaccagtgaagaggcagcggttggcctgtctcgaaacaatttgtttgatgtctggaccctcgactatattgaatattattgtggttattactttgacctgttcatcgc

SEQ ID NO: 71 - protein, 147 aa, Oryza sativa
MLPLSLLKTAQGHPMLVELKNGETYNGHLVNCDTWMNIHLREVICTSKDGDKFWRMPECYIRGNTIKYLRVPDEVIDKVQEETSKSRSDRRPPGVGRGRGRGDIGTKPGGRGIGRGQDDGGSKGGGGRGRGGIGGKGGIKGGGRGRG

SEQ ID NO: 72 - DNA, 681 bp, Oryza sativa
acccaaagcagaagcctccgccgccgcagcgccgctactcttgcatcgcctccgccgtagccgcgcgcgcccttcccgtcgccgcttccacctcgatctccgccggagagggcgtccgccgccatgtctcagaacaacccctcccagctcctcccctcagagctgattgaccgctgcatcgggtccaagatttgggtgattatgaagggtgacaaggagctcgtcggcactctctgtgggttcgatgtgtacgtcaacatggtgctcgaggacgttactgagtatgaatacactgctgaaggccgtcgcataacaaagcttgatcagatactcctaaacggcaacaatatagctattttggttcctggtggttctcccccagatgtggcataagcaagcacttccgtgatatacctgcttgaggctgatggaggcacagaccggtgtttccttacttcaaatgtatttcttccatttgtggctgtactgaactttcttagttaactgacctgaagtagtgtacctgcaacagttgctcctacatgatttggcaatgctaagtatgaggtacctcttgtagctgtttattaccattcttctgcaacctgactcagtaaacactaggtggttgaagaaacctgataatggagagcatatctacaattgttgtatttgtggttc

SEQ ID NO: 73 - protein, 89 aa, Oryza sativa
MSQNNPSQLLPSELIDRCIGSKIWVIMKGDKELVGTLCGFDVYVNMVLEDVTEYEYTAEGRRITKLDQILLNGNNIAILVPGGSPPDVA

SEQ ID NO: 74 - DNA, 548 bp, Oryza sativa
ctctctctttctcacccaaccccaactctacacgcacgcggcgacagcgagagagatgagcaccggcggcggcgcggacaagtccggcggcggcggcggaggggcggtgaagacgccctcggacttcctcaagtcgatcaggggacgccccgtcgtcgtcaagctcaactccggcgtcgactaccgaggtattttggcttgcctggatgggtatatgaacattgcaatggagcaaacggaagagtatgtgaatggccaactcaagaacaagtatggtgatgccttcataagaggcaacaatgttctatacatcagcacttcgaagaggacccttacggatgacgcatagatcgagtggaacagagtcgactctttttaacttcaaaatcgttaagctgattggttgtgatctctctctgacccatgctcgtacctgctgttttgaggtgggaaaatgtattgcatattgctagacttatcagaaacttctttaatgtaactgtatcagctttgcaaagaacttccggccaagatctccagttgcattt

SEQ ID NO: 75 - protein, 97 aa, Oryza sativa
MSTGGGADKSGGGGGGAVKTPSDFLKSIRGRPVVVKLNSGVDYRGILACLDGYMNIAMEQTEEYVNGQLKNKYGDAFIRGNNVLYISTSKRTLTDDA

SEQ ID NO: 76 - DNA, 586 bp, Oryza sativa
gaagaaaaaaaaagagaaaaacacaacaccatcaacccccgcatccgccaccgccgccaccaccccctaactccgatttgaagcgaccagaggccgcggctaaggtccgggatgtcggggcgcaaggagacggtgctggacctggccaagttcgtcgacaagggcgtccaggtcaagctcaccggcggcaggcaagttacagggactttgaagggctatgaccagcttctaaacttggtgcttgatgaagcggttgaatttgaaagagagcaagatgatccattgaaactatcagggaaaaccagacagcttggtcttattgtctgtaggggtacagcggtgatgcttgtatcgccaaccgatggaacggacgagattgccaaccccttccaatctgatggtgcataaacctgcaggagctgatggttctcctagtcaagatccatgctctcccagtagagaggcctttgtattaactcatgtaatctggtgccacagtctcttatgactcgtgtctcttatgaacaccaggtggtggtctgttctgtaccactcgaaactgatttctgaagatccttgctttgtg

SEQ ID NO: 77 - protein, 98 aa, Oryza sativa
MSGRKETVLDLAKFVDKGVQVKLTGGRQVTGTLKGYDQLLNLVLDEAVEFEREQDDPLKLSGKTRQLGLIVCRGTAVMLVSPTDGTDEIANPFQSDGA

SEQ ID NO: 78 - DNA, 718 bp, Oryza sativa
ctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccagatcatatccgtcatcacaaacgatggccgcaacattgtggggacactcagaggattcgatcaagccaccaacatcatcctcgatgagtcccatgagagggtctattctaccagggagggagtgcaacagcttgttcttgggttgtacatcataaggggcgacaacatcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcag

SEQ ID NO: 79 - protein, 99 aa, Oryza sativa
MASAGPGLESLVDQIISVITNDGRNIVGTLRGFDQATNIILDESHERVYSTREGVQQLVLGLYIIRGDNISVVGEVDEELDARLDLSNLRAHPLKPVIH

SEQ ID NO: 80 - DNA, 411 bp, Oryza sativa
atgtcgtcgtgggccgggcccgacgagatcttcctctccacgtccctggccggcttcttggacaagaaacttattgtcctactacgagatggacggaagctgcttggcacactctgctcatttgatcagtttgcaaatgttgttcttcagggtgcttgtgaacgagtaattgtaggtgaactatattgtgatgttcctcttggtctatatgtgatccggggagagaatgtcgtattaatcggagaattggtctggttttggattgagcaggatcgtgagaaggatgaactccctgctcacatgacttgtgtttcagaggctgaaataagaaaggctgagaaagcagaaagggaagcgagagatctgaaaggttcaatgaggaagaggatggagttcttagactttgattag

SEQ ID NO: 81 - protein, 136 aa, Oryza sativa
MSSWAGPDEIFLSTSLAGFLDKKLIVLLRDGRKLLGTLCSFDQFANVVLQGACERVIVGELYCDVPLGLYVIRGENVVLIGELVWFWIEQDREKDELPAHMTCVSEAEIRKAEKAEREARDLKGSMRKRMEFLDFD

SEQ ID NO: 82 - DNA, 297 bp, Linum usitatissimum
atggcttccggtcttggactcgaatctcttgttgaccaaactatttctgtgatcacaaatgatggccgcaacatagtgggcaacttgaaaggcttcgatcaggccactaatatcatcctcgatgaatcccatgaacgtgtttactccaccaaggaaggcgtgcaacaactggttttgggcttgtacataataaggggtgataatataagcgtgattggggagcttgacgaggaacttgatgcgcagcttgatatgtcgaatctcagagcacatcccctcaaacctgtgattcattga

SEQ ID NO: 83 - protein, 98 aa, Linum usitatissimum
MASGLGLESLVDQTISVITNDGRNIVGNLKGFDQATNIILDESHERVYSTKEGVQQLVLGLYIIRGDNISVIGELDEELDAQLDMSNLRAHPLKPVIH

SEQ ID NO: 84 - DNA, 288 bp, Brassica napus
atgggtctacttcggtcatttgatcaatttgcaaatgctgtaatagaagaagcttatgaaagagtcatcgtgggtgatctctactgtgatattcccttgggtctttacataatccgtggagaaaatgttgtcttgattggtgaactggacattgaaaaggaagagcttcctgctcaaatggtccaagtctcagaggcagagatcaaaagggctcagaaagcagagaaagaagaaatgctactgaagggtttgatgcggaaaagaatggagttccttgatctcgattag

SEQ ID NO: 85 - protein, 95 aa, Brassica napus
MGLLRSFDQFANAVIEEAYERVIVGDLYCDIPLGLYIIRGENVVLIGELDIEKEELPAQMVQVSEAEIKRAQKAEKEEMLLKGLMRKRMEFLDLD

SEQ ID NO: 86 - DNA, 387 bp, Brassica napus
atgtcttgggctggtcctgaagatatttacctttcaacttcactcgctagttatctcgatagaaagatacttgtgctccttagagatggtagaaagctaatgggaacgctccgttcatttgatcaattcgccaatgcggttttagaaggtgcgtgcgagagggtaattgttggtgagcaatactgcgacattcctttaggcctctatgtaatccgtggagagaatgttgttctcattggtgaccttgacactgagagagaggagcttcctccaaatatgattcgcgtctcagagacagagattaaaagggcgcaaaaagtggagagggaagcgagtgagctgagaggaacaatgaggaagagaatggagtttcttgacttcgattaa

SEQ ID NO: 87 - protein, 128 aa, Brassica napus
MSWAGPEDIYLSTSLASYLDRKILVLLRDGRKLMGTLRSFDQFANAVLEGACERVIVGEQYCDIPLGLYVIRGENVVLIGDLDTEREELPPNMIRVSETEIKRAQKVEREASELRGTMRKRMEFLDFD

SEQ ID NO: 88 - DNA, 375 bp, Brassica napus
tcttgggctgctcctgatgatatcttcttctccacttctctcgccgcctacttagacaagaagcttcttgtcttgcttcgtgatggtcggaaactgatgggtctacttcggtcatttgatcaatttgcaaatgctgtaatagaagaagcttatgaaagagtcatcgtgggtgatctctactgtgatattcccttaggtctttacataatccgtggagaaaatgttgtcttgattggtgaactggacgttgaaaaggaagagcttcctgctcaaatggtccaagtctcagaggcagagatcaaaagggctcagaaagcagagaaagaagaaatgctactgaagggtttgatgcggaaaagaatggagttccttgat

SEQ ID NO: 89 - protein, 128 aa, Brassica napus; identical to SEQ ID NO: 87

SEQ ID NO: 90 - DNA, 390 bp, Brassica napus
atgcttcctctttcgctactcaagactgctcaaggacatcccatgcttgtggagctcaagaatggagagacatacaatgggcatttagtaaattgcgatacgtggatgaacatccatctgcgtgaagttatctgcacatcaaaggatggagacaggttttggaggatgccggaatgttatatccgtggtaacactatcaagtaccttcgtgttccagatgaggtgattgataaagtacaggaggagaagacccgcacagataggaaaccaccaggggttggacgtggaagaggacgtggtatggatgatggaggggccagaggacgaggccgaggagctccaatggctaagatgagtggcaacagaggagcagggcgtgggcgtggttga

SEQ ID NO: 91 - protein, 129 aa, Brassica napus
MLPLSLLKTAQGHPMLVELKNGETYNGHLVNCDTWMNIHLREVICTSKDGDRFWRMPECYIRGNTIKYLRVPDEVIDKVQEEKTRTDRKPPGVGRGRGRGMDDGGARGRGRGAPMAKMSGNRGAGRGRG

SEQ ID NO: 92 - DNA, 390 bp, Brassica napus
atgcttcctctttcgctgctcaagactgctcaagggcatcccatgcttgtggagctcaagaatggcgagacatacaatgggcatttagtgaattgtgatacgtggatgaacattcatcttcgtgaagtcatctgcacatcaaaggacggagacaggttttggaggatgccggagtgttacatccgcggtaacacgatcaagtaccttcgagttccagatgaggtgattgataaagtacaggaggagaagacccgcacagataggaaaccaccaggggttggccgtgggagaggacgtggtatggatgatggaggggccagaggccgtggccgaggagctccaatggcgaagatgagtggcaacagaggagcaggtcgtgggcgtggttga

SEQ ID NO: 93 - protein, 129 aa, Brassica napus; identical to SEQ ID NO: 91

SEQ ID NO: 94 - DNA, 390 bp, Brassica napus
atgcttcctctttcgctgctcaagactgctcaagggcatcccatgcttgtggagctcaagaatggagagacgtacaatgggcatttagtgaattgtgatacgtggatgaacattcatctgcgtgaagtcatctgcacatcaaaggacggagacaggttttggaggatgccggagtgttatatccgcggtaacactatcaagtaccttcgagttccagatgaggtgattgataaagtacaggaggagaagacccgcacagatagaaaaccaccaggggttggacgtgggagaggacgtggtgtggatgatggaggggccagaggccgtggtcgaggagctccaatggcgaagatgagtggcaacagaggagcaggtcgtggccgtggttga

SEQ ID NO: 95 - protein, 129 aa, Brassica napus
MLPLSLLKTAQGHPMLVELKNGETYNGHLVNCDTWMNIHLREVICTSKDGDRFWRMPECYIRGNTIKYLRVPDEVIDKVQEEKTRTDRKPPGVGRGRGRGVDDGGARGRGRGAPMAKMSGNRGAGRGRG

SEQ ID NO: 96 - DNA, 450 bp, Glycine max
atgcttcccctttcccttctcaagactgcccaaggccaccccatgctggtggaactgaaaaatggggagacttataacgggcacttggttaattgtgatacatggatgaacatccatctccgagaagtcatttgtacctctaaagatggagatagattttggcgtatgcctgagtgctacattcgtggcaataccattaagtaccttcgggttcctgatgaggttattgacaaagtccaggaagaaacaaagagccgtactgatcgcaaaccccctggtgtgggacgtggaaggggaagaggtagggatgatggtcctggtggacgtcaacctaaaggaattgggcgaggtattgatgagggtggagctaaaggacaaggaggacgaggccggggtggtccaggtggaaaacccagtggaaacagaggtgcagggcgaggtagaggttga

SEQ ID NO: 97 - protein, 149 aa, Glycine max
MLPLSLLKTAQGHPMLVELKNGETYNGHLVNCDTWMNIHLREVICTSKDGDRFWRMPECYIRGNTIKYLRVPDEVIDKVQEETKSRTDRKPPGVGRGRGRGRDDGPGGRQPKGIGRGIDEGGAKGQGGRGRGGPGGKPSGNRGAGRGRG

SEQ ID NO: 98 - DNA, 450 bp, Glycine max
atgctgcccctttcccttctcaagactgcccaaggccaccctatgctagtggaactgaaaaatggggagacttataacgggcacttggttaattgtgatacatggatgaacattcatctccgagaagtcatttgtacctctaaagatggagatagattttggcgtatgcccgagtgctacattcgcggcaataccataaagtaccttcgggttcctgatgaggttattgacaaagtccaggaagaaacaaagagccgcactgatcgcaaaccccctggtgtgggacgtggaagaggaagaggtagggaggatggtcctggtggacgtcaaccaaaaggaattgggcgtggccttgatgaaggtggacctaaaggacaaggaggacgaggtaggggtggtcccggtggaaagcctggtggaaacagaggtggagggcgaggtagaggttga

SEQ ID NO: 99 - protein, 149 aa, Glycine max
MLPLSLLKTAQGHPMLVELKNGETYNGHLVNCDTWMNIHLREVICTSKDGDRFWRMPECYIRGNTIKYLRVPDEVIDKVQEETKSRTDRKPPGVGRGRGRGREDGPGGRQPKGIGRGLDEGGPKGQGGRGRGGPGGKPGGNRGGGRGRG

SEQ ID NO: 100 - DNA, 450 bp, Glycine max; identical to SEQ ID NO: 96

SEQ ID NO: 101 - protein, 149 aa, Glycine max; identical to SEQ ID NO: 97

SEQ ID NO: 102 - DNA, 264 bp, Glycine max
atggccaacaatccgtcacagcttctcccatcagagttgattgaccggtgtataggttcgaaaatttgggtgataatgaagggtgacaaggagcttgttggtactcttagaggctttgatgtttatgtcaacatggtccttgaagatgttactgaatatgagatcactgctgaagggagacggataaccaagcttgatcagattttactcaatggaaacaacattgccattttggtccctggtggttctcctgagtcagaatga

SEQ ID NO: 103 - protein, 87 aa, Glycine max
MANNPSQLLPSELIDRCIGSKIWVIMKGDKELVGTLRGFDVYVNMVLEDVTEYEITAEGRRITKLDQILLNGNNIAILVPGGSPESE

SEQ ID NO: 104 - DNA, 387 bp, Hordeum vulgare
atgtcttgggccgggcccgacgagatcctcctctccacctccctggccggcttcttagataaaaaactgattgtcctgctacgagatggacgaaagctgcttggcactctctgctcattcgatcagtttgcaaatgttgttcttcagggtgcttgtgaacgagtgattgtgggcgaattatattgtgatgttcctcttggtttatatgtgatccggggagagaatgttgtattaattggagaactggatcgtgagaaggacgaactccctagccacatgacttgtgtttcagaggctgaaataagaacggccgagaaagccgaaaaggaagcaagggatctgaaaggcacaatgaggaagaggatggagttcctagacttcgattag

SEQ ID NO: 105 - protein, 128 aa, Hordeum vulgare
MSWAGPDEILLSTSLAGFLDKKLIVLLRDGRKLLGTLCSFDQFANVVLQGACERVIVGELYCDVPLGLYVIRGENVVLIGELDREKDELPSHMTCVSEAEIRTAEKAEKEARDLKGTMRKRMEFLDFD

SEQ ID NO: 106 - DNA, 432 bp, Hordeum vulgare
atgcttcccctctcgctcctcaagaccgcccaggggcatcccatgctcgtggagctcaagaacggcgagacctacaatgggcacttggtcaactgcgacacgtggatgaacatccacctccgggaggttatttgcacctctaaggatggtgataagttttggaggatgccggagtgctatattcgtggtaacacaatcaagtatcttcgggttcctgatgaggtgattgacaaggttcaagaggaaacttctaagagtagatcagataggaagccgccaggtgttggccgcggaagaggaagaggagatataggcactaaacctggaggcagaggcatcgggcgtggccaagatgatggcaaaggcggtggccgtggaaggggcggaattggaagtaaaggtggcaacaaaggtggacgtggccgtgggtga

SEQ ID NO: 107 - protein, 143 aa, Hordeum vulgare
MLPLSLLKTAQGHPMLVELKNGETYNGHLVNCDTWMNIHLREVICTSKDGDKFWRMPECYIRGNTIKYLRVPDEVIDKVQEETSKSRSDRKPPGVGRGRGRGDIGTKPGGRGIGRGQDDGKGGGRGRGGIGSKGGNKGGRGRG

SEQ ID NO: 108 - DNA, 387 bp, Triticum aestivum
atgtcttgggccgggcccgacgagatcctcctctccacctccctggccggcttcttggataaaaaactaattgtcctactacgagatggacgaaagctgcttggcaccctctgctcattcgatcagtttgcaaatgttgttcttcagggtgcttgtgaacgagtaattgtgggcgaattatattgtgatgttcctcttggtttatatgtgatccggggagagaatgttgtattaattggagaactggatcgtgagaaggacgaactccctagtcacatgacttgtgtttcagaggctgaaataagaacggccgagaaagctgaaaaggaagcaagggatctgaaaggcacaatgaggaagaggatggagttcctagacttcgattag

SEQ ID NO: 109 - protein, 128 aa, Triticum aestivum; identical to SEQ ID NO: 105

SEQ ID NO: 110 - DNA, 432 bp, Triticum aestivum
atgcttcccctctcgctcctcaagaccgcccaggggcatcccatgctcgtggagctcaaaaacggcgagacctacaatgggcacttggtgaactgcgacacgtggatgaacatccacctccgggaggttatttgcacctccaaggatggtgataagttttggaggatgccggagtgctatattcgtgggaacacaatcaagtatcttcgggttcctgatgaggtgattgacaaggttcaagaggaaacttctaagagtagatctgataggaagccaccaggtgttggccgcggaagaggaagaggagatataggcactaaacctgggggcagaggcatcggacgtggccaagatgatggcaaaggcggtggccgcggaaggggcggaattggaagtaaaggtggcaacaaaggcggacgtggtcgtgggtaa

SEQ ID NO: 111 - protein, 143 aa, Triticum aestivum; identical to SEQ ID NO: 107

SEQ ID NO: 112 - DNA, 432 bp, Triticum aestivum
atgcttcccctctcgctcctcaagaccgcccaggggcatcccatgctcgtggagctcaagaacggcgagacctacaatgggcacttggtgaactgcgacacgtggatgaacatccacctccgggaggttatttgcacctctaaggatggtgataagttttggaggatgccggagtgctatattcgtggtaacacgatcaagtatcttcgggttcctgatgaggtgattgacaaggttcaagaggaaacttctaagagtagatcagataggaagccaccaggtgttggtcgtggaagaggaagaggagatataggcactaaacctggaggcagaggcattggtcgtggccaagatgatggcaaaggcggtggccgtggaaggggcggaattggaagtaaaggtggcaacaaaggcggacgtggtcgtgggtaa

SEQ ID NO: 113 - protein, 143 aa, Triticum aestivum; identical to SEQ ID NO: 107

SEQ ID NO: 114 - DNA, 387 bp, Zea mays
atgtcttggtccgcgcccgacgacatcctcctctccacctcactcgcgggcttcctggacaagaaacttattgtcctgctaagagatggacggaaacttcttggcaccctctgctcatttgatcagtttgcaaatgttgttcttcagggtgcttgtgaacgagtgattgtagggggacaatattgtgatgttcctcttggtctgtatgtgatccggggagagaacgttgttttaatcggagaattggatcacgaaaaggatgaactccccgctcacatgacatgtgttttagaagcagaaattagaaaggctgagaaggcggagcgggaagcaagggatctgaaaggcacgatgaggaaacggatggagttcctagacttcgactga

SEQ ID NO: 115 - protein, 128 aa, Zea mays
MSWSAPDDILLSTSLAGFLDKKLIVLLRDGRKLLGTLCSFDQFANVVLQGACERVIVGGQYCDVPLGLYVIRGENVVLIGELDHEKDELPAHMTCVLEAEIRKAEKAEREARDLKGTMRKRMEFLDFD

SEQ ID NO: 116 - DNA, 441 bp, Zea mays
atgcttcccctctcgctcctcaagaccgcccaggggcacccaatgctcgtggagctgaagaatggtgagacgtacaacgggcatctggtcaattgcgacacgtggatgaacatccaccttagggaggttatttgcacctcaaaggatggtgacaagttttggaggatgccagagtgttacattcgtgggaacaccattaagtatcttcgagttcctgatgaggtgattgacaaggttcaggaggaaacttccaaaagccggtcagataggaagccaccaggtgttggccgcggaagaggaaggggggacgttggtgctaaacctggaggcagaggcatcggacgtggccaagatgatggaggtagaggcagtggtggccgaggaaggggtggagttggtgccaaaggtggtaacaaaggtgggggccgtggccgtggctaa

SEQ ID NO: 117 - protein, 146 aa, Zea mays
MLPLSLLKTAQGHPMLVELKNGETYNGHLVNCDTWMNIHLREVICTSKDGDKFWRMPECYIRGNTIKYLRVPDEVIDKVQEETSKSRSDRKPPGVGRGRGRGDVGAKPGGRGIGRGQDDGGRGSGGRGRGGVGAKGGNKGGGRGRG

SEQ ID NO: 118 - protein, 82 aa, Artificial sequence
  consensus Lsm domain - plants
  UNSURE (4)..(4): Xaa can be any naturally occurring amino acid
  UNSURE (10)..(10): Xaa can be any naturally occurring amino acid
  UNSURE (13)..(14): Xaa can be any naturally occurring amino acid
  UNSURE (18)..(18): Xaa can be any naturally occurring amino acid
  UNSURE (21)..(21): Xaa can be any naturally occurring amino acid
  UNSURE (24)..(24): Xaa can be any naturally occurring amino acid
  UNSURE (26)..(26): Xaa can be any naturally occurring amino acid
  UNSURE (28)..(28): Xaa can be any naturally occurring amino acid
  UNSURE (30)..(31): Xaa can be any naturally occurring amino acid
  UNSURE (41)..(41): Xaa can be any naturally occurring amino acid
  UNSURE (44)..(44): Xaa can be any naturally occurring amino acid
  UNSURE (46)..(46): Xaa can be any naturally occurring amino acid
  UNSURE (48)..(49): Xaa can be any naturally occurring amino acid
  UNSURE (52)..(62): Xaa can be any naturally occurring amino acid
  UNSURE (64)..(64): Xaa can be any naturally occurring amino acid
  UNSURE (66)..(67): Xaa can be any naturally occurring amino acid
  UNSURE (72)..(73): Xaa can be any naturally occurring amino acid
  UNSURE (76)..(76): Xaa can be any naturally occurring amino acid
  UNSURE (79)..(81): Xaa can be any naturally occurring amino acid
MLPXSLLKTXLGXXMLVXLKXGRXLXGXLXXFDQWMNIVLXEVXEXVXXGDXXXXXXXXXXXLXEXXIRGNXXNIXYLXXXD

SEQ ID NO: 119 - protein, 92 aa, Artificial sequence
  consensus Lsm domain
  UNSURE (1)..(7): Xaa can be any naturally occurring amino acid
  UNSURE (10)..(10): Xaa can be any naturally occurring amino acid
  UNSURE (12)..(17): Xaa can be any naturally occurring amino acid
  UNSURE (21)..(21): Xaa can be any naturally occurring amino acid
  UNSURE (26)..(27): Xaa can be any naturally occurring amino acid
  UNSURE (29)..(29): Xaa can be any naturally occurring amino acid
  UNSURE (31)..(31): Xaa can be any naturally occurring amino acid
  UNSURE (33)..(34): Xaa can be any naturally occurring amino acid
  UNSURE (37)..(37): Xaa can be any naturally occurring amino acid
  UNSURE (39)..(39): Xaa can be any naturally occurring amino acid
  UNSURE (44)..(64): Xaa can be any naturally occurring amino acid
  UNSURE (66)..(78): Xaa can be any naturally occurring amino acid
  UNSURE (85)..(85): Xaa can be any naturally occurring amino acid
  UNSURE (89)..(89): Xaa can be any naturally occurring amino acid
  UNSURE (91)..(92): Xaa can be any naturally occurring amino acid
XXXXXXXLNXAXXXXXXVTVXLKNGXXLXGXVXXFDXFXNLLLXXXXXXXXXXXXXXXXXXXXXKXXXXXXXXXXXXXLVYLRGXSIIXIXX

SEQ ID NO: 120 - protein, 83 aa, Arabidopsis thaliana
MSWAAPDDIFFSTSLAAYLDKKLLVLLRDGRKLMGLLRSFDQFANAVLEEAYERVIVGDLYCDIPLGLYIIRGENVVLIGELD

SEQ ID NO: 121 - protein, 83 aa, Arabidopsis thaliana
MSWAGPEEIYLSTSLASYLDRKLLVLLRDGRKLMGTLRSFDQFANAVLEGACERVIVGEQYCDIPLGLYVIRGENVVLIGELD

SEQ ID NO: 122 - protein, 74 aa, Arabidopsis thaliana
MLFFSYFKDLVGQEVTVELKNDLAIRGTLHSVDQYLNIKLENTRVVDQDKYPHMLSVRNCFIRGSVVRYVQLPK

SEQ ID NO: 123 - protein, 84 aa, Arabidopsis thaliana
MSVEEDATVREPLDLIRLSIEERIYVKLRSDRELRGKLHAFDQHLNMILGDVEEVITTIEIDDETYEEIVRTTKRTVPFLFVRG

SEQ ID NO: 124 - protein, 84 aa, Arabidopsis thaliana
MSGEEEATVREPLDLIRLSLDERIYVKLRSDRELRGKLHAFDQHLNMILGDVEETITTVEIDDETYEEIVRTTKRTIEFLFVRG

SEQ ID NO: 125 - protein, 73 aa, Arabidopsis thaliana
MLPLSLLKTAQGHPMLVELKNGETYNGHLVNCDTWMNIHLREVICTSKDGDRFWRMPECYIRGNTIKYLRVPD

SEQ ID NO: 126 - protein, 82 aa, Arabidopsis thaliana
MANNPSQLLPSELIDRCIGSKIWVIMKGDKELVGILKGFDVYVNMVLEDVTEYEITAEGRRVTKLDQILLNGNNIAILVPGG

SEQ ID NO: 127 - protein, 84 aa, Arabidopsis thaliana
MSGVEEKVSGTTKTPADFLKSIRGRPVVVKLNSGVDYRGTLTCLDGYMNIAMEQTEEYVNGQLKNKYGDAFIRGNNVLYISTVN

SEQ ID NO: 128 - protein, 84 aa, Arabidopsis thaliana
MSGVGEKASGTTKTPADFLKSIRGKPVVVKLNSGVDYRGILTCLDGYMNIAMEQTEEYVNGQLKNTYGDAFVRGNNVLYISTTK

SEQ ID NO: 129 - protein, 84 aa, Arabidopsis thaliana
MSGRKETVLDLAKFVDKGVQVKLTGGRQVTGTLKGYDQLLNLVLDEAVEFVRDHDDPLKTTDQTRRLGLIVCRGTAVMLVSPTD

SEQ ID NO: 130 - protein, 76 aa, Arabidopsis thaliana
MAATTGLETLVDQIISVITNDGRNIVGVLKGFDQATNIILDESHERVFSTKEGVQQHVLGLYIIRGDNIGVIGELD

SEQ ID NO: 131 - protein, 44 aa, Medicago truncatula
SFDQFANVVLEGACERVIVGDLYCDVPLGLYVIRGENVVLIGEL

SEQ ID NO: 132 - protein, 51 aa, Populus trichocarpa
LMGLLRSFDQFANAVLEGACERVIVGDLYCDIHLGLYVIRGENVVLIGELD

SEQ ID NO: 133 - protein, 84 aa, Oryza sativa
MSSWAGPDEIFLSTSLAGFLDKKLIVLLRDGRKLLGTLCSFDQFANVVLQGACERVIVGELYCDVPLGLYVIRGENVVLIGELD

SEQ ID NO: 134 - protein, 91 aa, Oryza sativa
MAAAAAAAAAEEEIAVKEPLDLIRLSLDERIYVKLRSDRELRGKLHAYDQHLNMILGDVEEIVTTVEIDDETYEEIVRTTKRTIPFLFVRG

SEQ ID NO: 135 - protein, 84 aa, Oryza sativa
MSGRKETVLDLAKFVDKGVQVKLTGGRQVTGTLKGYDQLLNLVLDEAVEFEREQDDPLKLSGKTRQLGLIVCRGTAVMLVSPTD

SEQ ID NO: 136 - protein, 73 aa, Oryza sativa
MLPLSLLKTAQGHPMLVELKNGETYNGHLVNCDTWMNIHLREVICTSKDGDKFWRMPECYIRGNTIKYLRVPD

SEQ ID NO: 137 - protein, 83 aa, Oryza sativa
MSQNNPSQLLPSELIDRCIGSKIWVIMKGDKELVGTLCGFDVYVNMVLEDVTEYEYTAEGRRITKLDQILLNGNNIAILVPGG

SEQ ID NO: 138 - protein, 90 aa, Oryza sativa
MSTGGGADKSGGGGGGAVKTPSDFLKSIRGRPVVVKLNSGVDYRGILACLDGYMNIAMEQTEEYVNGQLKNKYGDAFIRGNNVLYISTSK

SEQ ID NO: 139 - protein, 77 aa, Oryza sativa
MASAGPGLESLVDQIISVITNDGRNIVGTLRGFDQATNIILDESHERVYSTREGVQQLVLGLYIIRGDNISVVGEVD

SEQ ID NO: 140 - protein, 74 aa, Oryza sativa
IFLSTSLAGFLDKKLIVLLRDGRKLLGTLCSFDQFANVVLQGACERVIVGELYCDVPLGLYVIRGENVVLIGEL

SEQ ID NO: 141 - protein, 76 aa, Linum usitatissimum
MASGLGLESLVDQTISVITNDGRNIVGNLKGFDQATNIILDESHERVYSTKEGVQQLVLGLYIIRGDNISVIGELD

SEQ ID NO: 142 - protein, 50 aa, Brassica napus
MGLLRSFDQFANAVIEEAYERVIVGDLYCDIPLGLYIIRGENVVLIGELD

SEQ ID NO: 143 - protein, 83 aa, Brassica napus
MSWAGPEDIYLSTSLASYLDRKILVLLRDGRKLMGTLRSFDQFANAVLEGACERVIVGEQYCDIPLGLYVIRGENVVLIGDLD

SEQ ID NO: 144 - protein, 83 aa, Brassica napus; identical to SEQ ID NO: 143

SEQ ID NO: 145 - protein, 73 aa, Brassica napus; identical to SEQ ID NO: 125

SEQ ID NO: 146 - protein, 73 aa, Brassica napus; identical to SEQ ID NO: 125

SEQ ID NO: 147 - protein, 73 aa, Brassica napus; identical to SEQ ID NO: 125

SEQ ID NO: 148 - protein, 73 aa, Glycine max; identical to SEQ ID NO: 125

SEQ ID NO: 149 - protein, 73 aa, Glycine max; identical to SEQ ID NO: 125

SEQ ID NO: 150 - protein, 73 aa, Glycine max; identical to SEQ ID NO: 125

SEQ ID NO: 151 - protein, 82 aa, Glycine max
MANNPSQLLPSELIDRCIGSKIWVIMKGDKELVGTLRGFDVYVNMVLEDVTEYEITAEGRRITKLDQILLNGNNIAILVPGG

SEQ ID NO: 152 - protein, 83 aa, Hordeum vulgare
MSWAGPDEILLSTSLAGFLDKKLIVLLRDGRKLLGTLCSFDQFANVVLQGACERVIVGELYCDVPLGLYVIRGENVVLIGELD

SEQ ID NO: 153 - protein, 73 aa, Hordeum vulgare; identical to SEQ ID NO: 136

SEQ ID NO: 154 - protein, 83 aa, Triticum aestivum; identical to SEQ ID NO: 152

SEQ ID NO: 155 - protein, 73 aa, Triticum aestivum; identical to SEQ ID NO: 136

SEQ ID NO: 156 - protein, 73 aa, Triticum aestivum; identical to SEQ ID NO: 136

SEQ ID NO: 157 - protein, 83 aa, Zea mays
MSWSAPDDILLSTSLAGFLDKKLIVLLRDGRKLLGTLCSFDQFANVVLQGACERVIVGGQYCDVPLGLYVIRGENVVLIGELD

SEQ ID NO: 158 - protein, 73 aa, Zea mays; identical to SEQ ID NO: 136

SEQ ID NO: 159 - protein, 46 aa, Artificial sequence
  Lsm protein motif 1
  UNSURE (4)..(4): Xaa can be any naturally occurring amino acid
  UNSURE (15)..(15): Xaa can be any naturally occurring amino acid
GTLXSFDQFANVVLXGACERVIVGELYCDVPLGLYVIRGENVVLIG

SEQ ID NO: 160 - protein, 23 aa, Artificial sequence
  Lsm protein motif 2
KAEREARDLKGTMRKRMEFLDFD

SEQ ID NO: 161 - DNA, 1828 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 162 - DNA, 53 bp, Artificial sequence
  sense primer
ggggacaagtttgtacaaaaaagcaggcttaaacaatgtcttgggctgctcct

SEQ ID NO: 163 - DNA, 50 bp, Artificial sequence
  antisense primer
ggggaccactttgtacaagaaagctgggttttctacaatgctgcaacaca

SEQ ID NO: 164 - DNA, 1827 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 165 - DNA, 975 bp, Arabidopsis thaliana
atggcggattttcagacatcaacacaacgggccaagtggattttcactccccagaaactggcagagagatataaagctgctaaccagagggcagtgcaaatgctggagaagtgtggaacaactcaagttgaagtagatgctagtggatcactaacatatcctaaagataaagttggttcaggagatcaagctgataagaagcttaagcctttgagtgctgatgaagaaaggttcatgagagcattttatgaggcaaaggtccaagaagtgtgcagtgcctttgcatttcctcacaagattcaggcaacagccctccaatactttaagagattttatctgcaatggtctgttatgcaacatcatccaaaagagataatgttaacctgtgtgtatgcagcttgtaaaatagaggagaatcatgtatctgctgaggaaattgggaaagggattaaccaagatcaccgaataattctcaagtacgagatggctgttcttcagagtttggaatttgatctgattgtttatgcaccgtatcgtgcaatcgaaggttttgtcaacaacatggaggaatttcttcaagctagagatgatgaaatccaaaaactagagtattctgcagagtttgctcaaaggggcgacagcagaagccgataaagttatgctcacagatgctccactcctctttcctcctggccagttggcattggcgtcgttacgtattgcaaatggggttcttggagtgattgactttgataggtacctagagaacattgtttctcaaccgaactctgagcacacgacttcagagcttacaaagttacttgataacatcgaatatttggtaaagaactacaagtgcccaagtgaaaaggacatgaagcatatcaaccggaagctaaaatcttgtctaggacatagttcttcacatgacgagagtaagaaacgggagaagagatcaaaacacaagtcccatag

SEQ ID NO: 166 - protein, 217 aa, Arabidopsis thaliana
MADFQTSTQRAKWIFTPQKLAERYKAANQRAVQMLEKCGTTQVEVDASGSLTYPKDKVGSGDQADKKLKPLSADEERFMRAFYEAKVQEVCSAFAFPHKIQATALQYFKRFYLQWSVMQHHPKEIMLTCVYAACKIEENHVSAEEIGKGINQDHRIILKYEMAVLQSLEFDLIVYAPYRAIEGFVNNMEEFLQARDDEIQKLEYSAEFAQRGDSRSR

SEQ ID NO: 167 - DNA, 54 bp, Artificial sequence
  primer: prm02688
ggggacaagtttgtacaaaaaagcaggcttcacaatggcggattttcagacatc

SEQ ID NO: 168 - DNA, 49 bp, Artificial sequence
  primer: prm02689
ggggaccactttgtacaagaaagctgggtaaactcaacctatgggtggc

SEQ ID NO: 169 - protein, 8 aa, Artificial sequence
  Cyclin H protein conserved motif
  VARIANT (1)..(1): Xaa is Val, Ile or Leu
  VARIANT (2)..(2): Xaa is Arg or Gln
  VARIANT (3)..(3): Xaa is Asp or Glu
  UNSURE (6)..(6): Xaa can be any naturally occurring amino acid
XXXVCXAF

SEQ ID NO: 170 - DNA, 1236 bp, Oryza sativa
ggtcagccaatacattgatccgttgccaatcatgcaaagtattttggctgtggccgagtgccggaattgataattgtgttctgactaaattaaatgaccagaagtcgctatcttccaatgtatccgaaacctggattaaacaatcctgttctgttctctagcccctcctgcatggccggattgtttttttgacatgttttcttgactgaggcctgtttgttctaaactttttcttcaaacttttaactttttcatcacatcagaacttttctacacatataaacttttaacttttccgtcacatcgttccaatttcaatcaaactttcaattttggcgtgaactaaacacaccctgagtcttttattgctcctccgtacgggttggctggttgagaataggtattttcagagagaaaatctagatattgggaggaacttggcatgaatggccactatatttagagcaattctacggtccttgaggaggtaccatgaggtaccaaaattttagtgtaaattttagtatctcattataactaggtattatgaggtaccaaatttacaatagaaaaaatagtacttcatggtactttcttaagtaccgtaaaattgctcctatatttaaggggatgtttatatctatccatatccataatttgattttgataagaaaaaatgtgagcacaccaagcatgtccatgaccttgcactcttggctcactcgtcaactgtgaagaacctcaaaaatgctcaatatagctacaggtgcctgaaaaaataactttaaagttttgaacatcgatttcactaaacaacaattattatctccctctgaaagatgatagtttagaactctagaatcattgtcggcggagaaagtaaattattttccccaaatttccagctatgaaaaaaccctcaccaaacaccatcaaacaagagttcaccaaaccgcccatgcggccatgctgtcacgcaacgcaccgcattgcctgatggccgctcgatgcatgcatgcttccccgtgcacatatccgacagacgcgccgtgtcagcgagctcctcgaccgacctgtgtagcccatgcaagcatccacccccgccacgtacaccccctcctcctccctacgtgtcaccgctctctccacctatatatgcccacctggcccctctcctcccatctccacttcacccgatcgcttcttcttcttcttcgttgcattcatcttgctagc

SEQ ID NO: 171 - DNA, 1828 bp, Oryza sativa; identical to SEQ ID NO: 161

SEQ ID NO: 172 - DNA, 1011 bp, Arabidopsis thaliana
atggcggattttcagacatcaacacaacgggccaagtggattttcactccccagaaactggcagagagatataaagctgctaaccagagggcagtgcaaatgctggagaagtgtggaacaactcaagttgaagtagatgctagtggatcactaacatatcctaaagataaagttggttcaggagatcaagctgataagaagcttaagcctttgagtgctgatgaagaaaggttcatgagagcattttatgaggcaaaggtccaagaagtgtgcagtgcctttgcatttcctcacaagattcaggcaacagccctccaatactttaagagattttatctgcaatggtctgttatgcaacatcatccaaaagagataatgttaacctgtgtgtatgcagcttgtaaaatagaggagaatcatgtatctgctgaggaaattgggaaagggattaaccaagatcaccgaataattctcaagtacgagatggctgttcttcagagtttggaatttgatctgattgtttatgcaccgtatcgtgcaatcgaaggttttgtcaacaacatggaggaatttcttcaagctagagatgatgaaatccaaaaactagagagtttgctcaaaggggcgacagcagaagccgataaagttatgctcacagatgctccactcctctttcctcctggccagttggcattggcgtcgttacgtattgcaaatggggttcttggagtgattgactttgataggtacctagagaacattgtttctcaaccgaactctgagcacacgacttcagagcttacaaagttacttgataacatcgaatatttggtaaagaactacaagtgcccaagtgaaaaggacatgaagcatatcaaccggaagctaaaatcttgtctaggacatagttcttcacatgacgagagtaagaaacgggagaagagatcaaaacacaagtcccataggagctccaatgatacaccaaacggggcaccgccacccataggttga

SEQ ID NO: 173 - protein, 336 aa, Arabidopsis thaliana
MADFQTSTQRAKWIFTPQKLAERYKAANQRAVQMLEKCGTTQVEVDASGSLTYPKDKVGSGDQADKKLKPLSADEERFMRAFYEAKVQEVCSAFAFPHKIQATALQYFKRFYLQWSVMQHHPKEIMLTCVYAACKIEENHVSAEEIGKGINQDHRIILKYEMAVLQSLEFDLIVYAPYRAIEGFVNNMEEFLQARDDEIQKLESLLKGATAEADKVMLTDAPLLFPPGQLALASLRIANGVLGVIDFDRYLENIVSQPNSEHTTSELTKLLDNIEYLVKNYKCPSEKDMKHINRKLKSCLGHSSSHDESKKREKRSKHKSHRSSNDTPNGAPPPIG

SEQ ID NO: 174 - DNA, 1204 bp, Populus tremula x Populus tremuloides
aataattcgaatataaattctctctgatcaaagaacaagtaacacaacacgctgatcactgagatagggttaccgagtcacccatggccgatttccaatcctcaagtcacaaagccaagtggatcttcacccctcaacagttggccgagaagtataaagctactaataatagagcgaaacaaatgttagagaagtatggaacgacaagaatgagagtagatgttgatgggtcattgtcatatccagaacctcaagttaacatgacagagaatgctgataagcattctcgttcaaaaccaataagtgtcgaggaagaacaatttatgcgagtatactatgagtataaacttcgagaagtgtgtagtgcattctattttcctcataaaattcaggcaactgcactcctatactttaaaaggttttatcttcaatggtcagtcatggagcatgatccaaaacatgtaatgttaacctgcatctatgcagcatgcaagatagaagaaaatcatgtgtctgcggaggagcttggtaaggggatttcacaggatcatcaaatgattctcaattacgagatgatagtttatcagagtttggaatttgatcttattgtctatgcaccatatcgatctgttgaaggttttgttgctgatatagaggaattctgtcatccaacagatgaaaatattgaaaagctgaaggaaattgcagtggcagaggttgacaaaatcatgctcactgacgcacccgttatgttccctcctgggcagttggcattggctgctctgcagagtgcaaatgagatgcatagagttcttgattttgagagatatctcgagagtgtcctctctcgtcagaattctgcacacatgatttcagagatcagtgaatctctacatgctgtcgagaaatgggtgaggaaatacagtttccctacggataaggatatgaagcacataaatcggaagctgaaatcatgctggggtcataactcacacgatgacaataagaaaagggagaagaaatcaaaacacaagtcccataagagttcgaatgaaatgcaaaatggcccaggactgacttaattgtatgttgctccttcgttcacaagtgtttcctaccttatttaagcgatttacgaacttggtttttgcttcccagatttttgttggagattatatttatgtaccaatttggatgaaaaaaa

SEQ ID NO: 175 - protein, 332 aa, Populus tremula x Populus tremuloides
MADFQSSSHKAKWIFTPQQLAEKYKATNNRAKQMLEKYGTTRMRVDVDGSLSYPEPQVNMTENADKHSRSKPISVEEEQFMRVYYEYKLREVCSAFYFPHKIQATALLYFKRFYLQWSVMEHDPKHVMLTCIYAACKIEENHVSAEELGKGISQDHQMILNYEMIVYQSLEFDLIVYAPYRSVEGFVADIEEFCHPTDENIEKLKEIAVAEVDKIMLTDAPVMFPPGQLALAALQSANEMHRVLDFERYLESVLSRQNSAHMISEISESLHAVEKWVRKYSFPTDKDMKHINRKLKSCWGHNSHDDNKKREKKSKHKSHKSSNEMQNGPGLT

SEQ ID NO: 176 - DNA, 1593 bp, Oryza sativa
cgacgacgcctccctcgtacgccggcgctctcgcagttgccgccgccgccgcgaacgcccaccgcccgcgctctggtcggtggatcgtgacgtgctgtggtggtctctgatctgctctgggggtgggtgggcgtctcgcggagtcgccgtgttcgtcgagggctcgatcggctcggggagagcgagtgagaagaggtgagggttggggggaggcacatccgcggcggcggagagatggcggatttccggacctccacgcatcgggagaggtggatcttccagacgaacgatctgatggatagatggggggcggcgaaccagcgggccacggagacgctcgttcagtatggaacgacgcggttgaaggtggaccctgttgatgggtcgctgtcatacccggaacctgcgcctgatcatgttgtagggagctcaggtgtaaagcctctgtcttgtgaagaggagcgattgatgcgggtattttatgagcaaaagattcaagaagtatgttcagcatttaagttccctcacaaaatccaggctaccgcaataatatatttcaagagattttatctgcaatggtctgtaatggaacatcacccaaagcatattatgttaacttgtatttattcttcttgcaaagtggaagaaaatcatgtttctgctgaggaacttggtaaaggaattcaacaggaccaccagattattctaaataacgagatgattgttctcaaatctttagattttgatctgattgtttatgctccgtatcgatctatcgaaggatttgttgatgacatggaggatttctgcagagcaggtaatggtgagcaccaacggttgcaggatttacgtcaaactgcgatatctcaggttgacaaaatgatgttgactgacgctcctcttctctacactcctggacagttggctctggctgctttgcacaaatccaatgatatgcacaagatccttaattttgaaaggtacttggaaagtgttttttcaaggcaacattctgattgtccaatcgaacaatttgttgggtcaatcaatatgatcaattatttggttgagcagcttaaaatacctactcctaaggacatgaggcatattgaccgcaagcttaagcattgtttggatccaagctcacaggatgagcataagaagaaagagaagaagtcgaagcacaaatcaaaaagggcagctaatgaagcccaacttgacagctagaaaacatacggttgggctgcaccgtgtaagaatcagttctttagtttgttgtggctccaattgatcaaaagagctactttcctgagcaggtgaggttccgttttagccgaggacaaccaattttgagatgaagcgagataatacccatgacctcgccttcttgtaatcttgtatgcctggaagccctagcaaactcctcgttgcaatggctactgtactttttttggggggtaatttatcccttgtcaaatgggaagaagcagcatacatcggatgattgcctccatatacgaaaatgacagctaactcagacttttgtcggttgcatttttctgtttaaaaaaaaaaaaaaaaaaaaaaaaaaaa

SEQ ID NO: 177 - protein, 330 aa, Oryza sativa
MADFRTSTHRERWIFQTNDLMDRWGAANQRATETLVQYGTTRLKVDPVDGSLSYPEPAPDHVVGSSGVKPLSCEEERLMRVFYEQKIQEVCSAFKFPHKIQATAIIYFKRFYLQWSVMEHHPKHIMLTCIYSSCKVEENHVSAEELGKGIQQDHQIILNNEMIVLKSLDFDLIVYAPYRSIEGFVDDMEDFCRAGNGEHQRLQDLRQTAISQVDKMMLTDAPLLYTPGQLALAALHKSNDMHKILNFERYLESVFSRQHSDCPIEQFVGSINMINYLVEQLKIPTPKDMRHIDRKLKHCLDPSSQDEHKKKEKKSKHKSKRAANEAQLDS

SEQ ID NO: 178 - DNA, 1434 bp, Lycopersicon esculentum
ggaaaatgccagtttattggaaagagaattagaatcggcagataaaagatatggcggatttcatgacatctactcataaaaccaagtggatttatactctccaagatattaaacataagtacaaagttgctaatcaaagggcgaaacaagcactagagatgtttggaacaactcgaatggaagttgatattgatgggactttctcgtatgctgaaagtcaaaatgacacaaaagataacgctgaaaagcgtcctaaaccactcaaagttgaagaagaacagcttctaagggctttctacgaattcaaaattcaagacgtttgtgatgcctttaagttccctcgtaagattcaggcaacagccctcatttattttaagaggttttatctgctgtggtccgtgatggaacatcaccccaaagacattatgttaacgtgcatatatgcagcttgcaaggcagaggaaaatcatgtatcagctgaggagcttggtaaggggattggacaggatcatcatgttatcctcaataatgagatgctggtttttcagagtctaggatttgatcttattgcttatgctccatatcgtgcactcgaaggttttatcagtaatttagaggagttctgtggagctcaagataacgaccagcttctggcactgaagggtgcacttgatactgctaggattgaagcagataagattatgcgtagtgatggaccacttctattcccacctgggcagttggcattgacagctctgcatagagctgatgcagcgcatggcatattcgattttgagaggtacttgagaagtgtcctatcacatcatgatcagccaggtcatgccatttcagaacttactgattctataaacgttatcgattctttggttggtaaacttttgactccgacttccaaagacgtgaagcacattgatcggaaactcaaatcatgtcttgatccgggttcacatgacaagagtaaaaaaaggaagcatagatccaaagatagctcaaatgaggttacagacatctcttgagctgctcttaactcaagtttgtagcttcaagcgtatgttatttggcaatagttcatcattgctgctcatcacagtttccagatatagagcaaaaaatccagtcatactggaagacaccgtctactacatttgcattaggtttgagagaagaagcagacgcggaaatgggatcaaagtttatgaattgaactcattgtattgtttaaattacgggatttgatcttatatttgttcagatttttagtagttatatcgaaagttatgattcagatgaacatgtagtcaaagccccaacatcttgtcccagagaagatcacattgttaaagatgtgtaagtaagaatggacttatttgtctgttttaatataacttttttggttttaaaaaaaaaaaaaaa

SEQ ID NO: 179 - protein, 328 aa, Lycopersicon esculentum
MADFMTSTHKTKWIYTLQDIKHKYKVANQRAKQALEMFGTTRMEVDIDGTFSYAESQNDTKDNAEKRPKPLKVEEEQLLRAFYEFKIQDVCDAFKFPRKIQATALIYFKRFYLLWSVMEHHPKDIMLTCIYAACKAEENHVSAEELGKGIGQDHHVILNNEMLVFQSLGFDLIAYAPYRALEGFISNLEEFCGAQDNDQLLALKGALDTARIEADKIMRSDGPLLFPPGQLALTALHRADAAHGIFDFERYLRSVLSHHDQPGHAISELTDSINVIDSLVGKLLTPTSKDVKHIDRKLKSCLDPGSHDKSKKRKHRSKDSSNEVTDIS

SEQ ID NO: 180 - DNA, 1600 bp, Zea mays
aaaaccatcaccgccttcccggcgctcgccgctgccacccgtcgccgcgcgcctttccgccacccgccgccgctgttggcgcccaaacatcgcatctgctgttgctttatcccttttattccacagccgctctaagtggtgggtgtccctctatattcgccgcttataggaatcgagggttcgatcggctgtggtgcgtggtgactgtgaacgaggaggagcgcaaagatggctgatttccggacctccacccaacgggagaggtggatcttccagtcgcacgatttgatggagaggtgggcggcggcaaaccagcgggccgctcagacccttgcgcagtatgggacgacccggcttaatgtggacctgcttgatggctcggtatcctacccagagtccatgccggatcatgttgagggtagctcggttgtaaagcctctttcttacgaagaggagcaattgacaagggtattttacgagcagaagattcaggaagtatgcgctgcattcaagttccctcacaaaatccaggctacagcaataatatatttcaagagattctatctacaatggtctgtaatggagcatcaaccaaagcatattatgttaacatgtgtatatgcttcttgcaaagtggaagaaaaccatgtttctgctgaggaacttggtaaaggaattcagcaggaccaccagatcattctaaataatgagatgattcttcttaaaactttagattttgatctcattgtttatgctccatatcgatcgattgaaggatttattgatgacctagaggatttctgcagggcaggtaatggtccattccagcgtttgaaggagttgcgccaggctgctatatcccatgttgacaaaatgatgttgactgatgcacctcttctctatacccctgggcagttggcactggcggctcttcacaagtctaatgatcttctcagggtcgtcgattttgaaagatacttggaaattatcttctcaaggcaacattctgattgtccaatcgaacagtttgttcagtcgatcaacgaaatcaattacttagtcgaccagcttaatatacctactgtcaaagacatgagacacgtggaccgcaagctgaaacattgctgggatccaagctcacatgacgagcataacaagaagaaagaaaagaagtcaaagcacaaatcgaaaagaacatctaccgatgcccaactataggaagcatatggtccagcagtggctttgtgtaagagtacaacgggcctccaaatgatcgaaactgaactcaggcatctaagcacagcagctctaagacagctttctacaccagctgaggcatacctgaggtcaagcaattttgtgacgatgtgggctatggaacttcattgctccaatgggagagttgcagcaaagatacaaactaagagatgtaacattggatgcctaactccaaagtacggagaacttcaaattttatatggccgactttgtgtcagccacaattacttgagttccttttgttacggatgtagcattgtttattaagtttaaacgccgaatccaagatgatccacctgctgttgtgaatcgttttttaact

SEQ ID NO: 181 - protein, 329 aa, Zea mays
MADFRTSTQRERWIFQSHDLMERWAAANQRAAQTLAQYGTTRLNVDLLDGSVSYPESMPDHVEGSSVVKPLSYEEEQLTRVFYEQKIQEVCAAFKFPHKIQATAIIYFKRFYLQWSVMEHQPKHIMLTCVYASCKVEENHVSAEELGKGIQQDHQIILNNEMILLKTLDFDLIVYAPYRSIEGFIDDLEDFCRAGNGPFQRLKELRQAAISHVDKMMLTDAPLLYTPGQLALAALHKSNDLLRVVDFERYLEIIFSRQHSDCPIEQFVQSINEINYLVDQLNIPTVKDMRHVDRKLKHCWDPSSHDEHNKKKEKKSKHKSKRTSTDAQL

SEQ ID NO: 182 - DNA, 1578 bp, Triticum aestivum
cgctgccgctgccgcccgtcgccgcgcccctcctcggcgtcctccggaagacgccatagtattgcggcatcccctccacacccgcttccatcaagcggtgttcaccagcaggggggaggggggctcgattcggctgctgggagcggaggtaggagcggccaagatgtcggatttccagacctccacgcaccgggagcggtggatcttccagccgcaggacctggtgaataagtggacgacggcgaaccggcgttcagcggagatcctcgcccagtatgggacgacgagattgaaggtggaccctgttgatggctcgatatcgaacccagaacctctgcctgatcatgttgttgggagctcgagcgtgaagcctctatcctgcgaagaggagcaagtgatgcggatattttacgagcaaaagattcaagaagtgtgcagagcattcaaattcccccacaaaattcaggctacagcgataatatatttcaagagattctatctacagtggtctgtaatggagcaccacccaaagcatattatgttaacttgtgtatatgcttcttgcaaagtggaagaaaatcatgtttctgctgaggaacttggcaaagggattcagcaggaccaccagatcattctaaataatgagatgattgttctgaaatctttagattttgatttgatcggtttatgctccatatcgttctatcgaaggatttattgatgacctggatgatttatgtagggcacgtaatggtgcacaccaacggttgaaggatttgcatcaaactgcgaattctgaggttgacacaatgatgttgactgatgcacctcttctctatactcctggacagttggctttggctgctctgtacaagtccaacagtgcactcagtgtcctcgattttgaaagatacttggaaagtgttttttcaaggcaacactttgattgtcctgtcgaacaatttattcagataatcagttcaatcaatcacctggttagccagcttcaactacctggtacgaaagaaatgaggcatgctgatcgcaagctgaagcattgtttggatccaagctcaagctctcatgatgaccacaagaagaaagaaaagaagtcaaagcacaaatcgaaaaggactgccagtgatgcccagctcaacagctagaaatcgtgcagttggacagctgtgctgtgtaagaaatcgtgcagttggtggcaaggacttgtactgtgctaggcgcgttagctgctttatcatgcaaccaagttctactcaagctcttcgattgatgcgatttcaattccgactttatccagccatcggatcagtgatgctgagcggatctcctcaccagcctaagtcttggctaaggacagacagttttcggatgaggcgccttactgtaaccttgcacgtcctgcgccagcgagtgctgtgctttttgtaactcaataattttattattagggaggcttaaatcttgggcgcgaggggagagaaactttgaggtgtaaaacattattactagagtaacttagggcctgtttggtttcaaataagtcaccaacttttaggtcgc

SEQ ID NO: 183 - protein, 332 aa, Triticum aestivum
MSDFQTSTHRERWIFQPQDLVNKWTTANRRSAEILAQYGTTRLKVDPVDGSISNPEPVPDHVVGSSSVKPLSCEEEQVMRIFYEQKIQEVCRAFKFPHKIQATAIIYFKRFYLQWSVMEHHPKHIMLTCVYASCKVEENHVSAEELGKGIQQDHQIILNNEMIVLKSLDFDLIVYAPYRSIEGFIDDMDDFCRAGNGAHQRLKDLHQTANSEVDTMMLTDAPLLYTPGQLALAALYKSNSALSVLDFERYLESVFSRQHFDCPVEQFIQIISSINHLVSQLQLPGTKEMRHADRKLKHCLDPSSSSHDDHKKKEKKSKHKSKRTASDAQLNS

SEQ ID NO: 184 - DNA, 1564 bp, Aquilegia formosa
atccctgtcatggcgattctcatcagctctggaaataaaactatctaaaaccctaacaatctccttctctctctctctctctctctctctctctctctctctctctctctctctctctctctctctctctctgaaatctccatggctgatttccaaacatcaacgcaccgagctaaatggattttcacaccaaatgaactggttgagaaatacaaagtttctaatcaaagagcaatcaaaatgctgaaggagtatgggtcaacacgtatagaagtgagtgctgatggttcattgtcttaccctgaacctcaattggatgcaactaaagttgaaaagcgctcccatacaaagccacttagtattgaagatgaacaacttatgcgggtgttctatgaacaaaagattcaagaagtgtgtctagcctttggatttccacagaaaattcagggtacagccatcatttatttcaagaggttctatttgcaatggtctgtaatggagcatcatccaaaaaatataatgttaacgtgcatatatgcttcatgtaaaatagaagaaaaccatgtatcagcagaggagcttggtaaaggcattcaacaggatcatcaagtgattctcaacaacgagatgctagttcttcagagtctgggatttgatcttattgtgtatgcaccatatcgctcaattgaaggttttgtcgatgatatagaggatttctgccaagcaaacgaccagctcgaaatgttgaaggacctgaaagaaactgcaaagttggaagtagatcgaattttacttacagatgcaccacttctgttcccacctgggcagttggcgttggctgctttgcgtaggtcgaacgaggtacatggagttcttgattttgagagatacttgggtagcatcatctctcgtcaacagtctatgcacactagttcagagctgattgaatctctgaatctgatatattctctgcttgtaaaactcaaaatgccttcaagcgatgatatgaagcccatagataggaaactaagatattgtttggatccaagcttgcaggatgataagaaacgtgaaaagagatcaaaacacaagtcgaagaaaagttcaagcgaaaagcatggcttgccttcttctacgccatcttaatttccaagccatgttgttattgtgcttcaggtggaggagcctatatgttttatatacaaagcagctgttcttcatgaacaagaaaatgcacctcgacccagtcagaatgttcacatgttttagaaagacagattggcaaactttcttcgaggacctctgttatacacacggtgttcctctccatccagttgctaatccattcactgtatgggatatatggcagcaaatagagctggacattattgttgtaaaaccaaaccctcagtttataaccaatgtcagactggtggcatcagaagaggagcatttttttgagttggtgatattattcttgttgtgagcaaattttttttttttttttggatatatttctgagcatttcagagtatgtacaacgggtagttgaaattttgtttgt

SEQ ID NO: 185 - protein, 334 aa, Aquilegia formosa
MADFQTSTHRAKWIFTPNELVEKYKVSNQRAIKMLKEYGSTRIEVSADGSLSYPEPQLDATKVEKRSHTKPLSIEDEQLMRVFYEQKIQEVCLAFGFPQKIQGTAIIYFKRFYLQWSVMEHHPKNIMLTCIYASCKIEENHVSAEELGKGIQQDHQVILNNEMLVLQSLGFDLIVYAPYRSIEGFVDDIEDFCQANDQLEMLKDLKETAKLEVDRILLTDAPLLFPPGQLALAALRRSNEVHGVLDFERYLGSIISRQQSMHTSSELIESLNLIYSLLVKLKMPSSDDMKPIDRKLRYCLDPSLQDDKKREKRSKHKSKKSSSEKHGLPSSTPS

SEQ ID NO: 186 - DNA, 1225 bp, Solanum tuberosum
ttcctccatcacaaagccttaagcccttccggtatattaacccgctgctggtctctccgggcgatcgattcaccggcgaaaaatctgcgatcttctagagatgaaacgctgggccatggcatagtttattggaagatcacatccaaacgaaaattagaattggcagagagaagacatggctgatttcgtgacatctactcataaaaccaagtggatttttactccccaagatattaaacataagtataaagttgctaatcacagagcgaaacaagcactagagaagtatggaacaacgcgaatggaagttgatattgatgggtcgttctcgtatgctgaaagtcaaaatgacgcaaaagatagtgctgaaaagcgtcctaaaccactcaaggttgaagaagaacaacttctaagggctttctacgagttcaaaattcaagacgtctgtgatgcctttaagttcccacgtaagattcaggcgacagctctcatttattttaagaggttttatctacaatggtccgtgatggaacatcaccctaaagacattatgttaacctgcatatatgcagcttgcaaggcagaggaaaaccatgtatcagctgaggagcttgggaagggtattggacaggatcatcatgtaatcctcaacaatgagatgctggttttccagagtctaggatttgatctaattgtttatgctccatatcgggctcttgaaagttttatcagtgatttagaggaattctgtggagctaaagatgaagaccagcttgtggcactgaagggttcacttgatactgctaggattgaagcagataagattatgcgttctgatggaccacttctattcccacctgggcagttggcattgacagctttgcatagagctaacgcagcgcatagcatatttgattttgagaggtacctaagaagtgtcctatcacattatgagccagctcatgccatttcagaacttgctggttctataaatgccattgattctttggttggcaaacttttgactccgacttccaaagatgtgaagcacgttgatcggaaactcaaatcatgtcttgatccggggttcacatgacaagagtaaaaaaaggaagcatagatccaaagatagctcacatgaggcctacagacatatcttgaaactgctctaactcagtttgtaacttcaagcatatcttattttgcccatggaatatattctcat

SEQ ID NO: 187 - protein, 305 aa, Solanum tuberosum
MADFVTSTHKTKWIFTPQDIKHKYKVANHRAKQALEKYGTTRMEVDIDGSFSYAESQNDAKDSAEKRPKPLKVEEEQLLRAFYEFKIQDVCDAFKFPRKIQATALIYFKRFYLQWSVMEHHPKDIMLTCIYAACKAEENHVSAEELGKGIGQDHHVILNNEMLVFQSLGFDLIVYAPYRALESFISDLEEFCGAKDEDQLVALKGSLDTARIEADKIMRSDGPLLFPPGQLALTALHRANAAHSIFDFERYLRSVLSHYEPAHAISELAGSINAIDSLVGKLLTPTSKDVKHVDRKLKSCLDPGF

SEQ ID NO: 188 - DNA, 1187 bp, Saccharum officinarum
ctccccggcgctcgccgctgccatccgtcgccgcgcgcctttccaccggtcgccgccgctattcgcgcccaaacagcgcatcctgctgttgtgtcattcctttccacagacacccgctctaagtggtgggtgccccgctatactcgccgcttatcggaaccgagggttcgatcggctgtgggtgactgtgaaggaggaggagcgcaaagatggctgatttccggacctcaacccaacgggagaggtggatcttccagtcgcacgatctgatggagaggtgggcggcggcaaaccagcgggctgctcagacccttgcgcagtatgggacgacgcggcttagtgtggacctgcttgatggctcggtctcctacccagagcccgcaccggatcatgttgagggtagctcgggtgtaaagcctctgtcttacgaagaggagcaattgacacgggtattttatgagcagaagattcaggaagtatgcgctgcattcaagttccctcacaaaatccaggctacagcaataatatatttcaagagattctatttacagtggtctgtaatggagcatcacccaaagcataatatgttaacatgtgtatatgcttcttgcaaagtggaagaaaaccatgtttctgctgaggaacttggtaaaggaattcagcaggaccaccagatcattctaaataatgagatgattcttcttaaaactttagattttgatctcattgtttatgctccatatcgatcgattgaaggatttattgatgacctagaggatttctgcagggcaggtaatggtccgttccagcgtttgaaggagttgcgccaggctgctatatcccgtgttgacaaaatgatgttgactgatgcacctcttctctatacccctgggcagttggcactggctgctcttcacaagtccaatgatcttctcagggtcgtcaattttgaaagatacttggaaactatcttctcaaggcaacattctgattgtccggtcgaacagtttgttcagtcgatcaacacaatcaattacttggttgaccagcttaatatacctactgttaaggacatgaggcacgtcgaacggaagctgaaacattgttgggattcaagctcccattatgagccttagaagaaagagaagaaagtcaagcccaaatttaaaaagaacatttggtggttc

SEQ ID NO: 189 - protein, 308 aa, Saccharum officinarum
MADFRTSTQRERWIFQSHDLMERWAAANQRAAQTLAQYGTTRLSVDLLDGSVSYPEPAPDHVEGSSGVKPLSYEEEQLTRVFYEQKIQEVCAAFKFPHKIQATAIIYFKRFYLQWSVMEHHPKHNMLTCVYASCKVEENHVSAEELGKGIQQDHQIILNNEMILLKTLDFDLIVYAPYRSIEGFIDDLEDFCRAGNGPFQRLKELRQAAISRVDKMMLTDAPLLYTPGQLALAALHKSNDLLRVVNFERYLETIFSRQHSDCPVEQFVQSINTINYLVDQLNIPTVKDMRHVERKLKHCWDSSSHYEP

SEQ ID NO: 190 - DNA, 969 bp, Ostreococcus tauri
atgtgcgattacgcctcatcgacgcagcgcgagcactggctccatgaatccgtcgcccaggtcgacgcgagacgcgcgcgcgcgcgcgtggagacgttcgagcgcgcgaaagcatcgagcgagtcgtcaacctcagccatggaaaccgaagcgctgacgcccgaagaggagcgaacgatcgtgaggtaccacgaggcgaagatacaatccgtctgcggcgcgtttgcgctgccgagaaaggtgaagaacacggcggtgatgctgttcaagcgcttcgcggtggattgcgggacgcacgcgcaatcgctgaagatcatgatgctgacgagcgtgtacgtagcgtgtaaggtggaggagagctacatctcggcggaggagttctgtaagggcgtgagagaggacccgtcgcgagtgttagcggcggaggtgacgtttctatctggattgaagtttcggttggtgtgctacggagcgacgcggccgctggacgggttcctgatggacgtcgaggacggtgggtgcaagggagcgacgtcgaaacagctcatcgagtgcagaaagaaagcgttagatatcgtcgatcggttgatgctgacggacgcgccgctgattcgaccgccggggcagatcgcgctgtgcgcgcttcgtcgggccgcgcgcgaatgcggggcgagtgaactcgaaaagtattgcgaagacgtcggcgcgcgagggacgaccaaggcgccgcgcggagcgaaactcaaggaaatcttagacgatatcgaatcgcacgtcgacgagggcgttgaacccgacgcggctgtcgtgaaggagattgacaaaaagctcaaactctggcgtgccaaatatctggctaagacgccggcagcggacgacgctggcgatgcgcagaaagctgcgaaacgtcgaaagagcgaacaatctagacaagacatgatcgccgccgaggaggacgcgctcggataa

SEQ ID NO: 191 - protein, 322 aa, Ostreococcus tauri
MCDYASSTQREHWLHESVAQVDARRARARVETFERAKASSESSTSAMETEALTPEEERTIVRYHEAKIQSVCGAFALPRKVKNTAVMLFKRFAVDCGTHAQSLKIMMLTSVYVACKVEESYISAEEFCKGVREDPSRVLAAEVTFLSGLKFRLVCYGATRPLDGFLMDVEDGGCKGATSKQLIECRKKALDIVDRLMLTDAPLIRPPGQIALCALRRAARECGASELEKYCEDVGARGTTKAPRGAKLKEILDDIESHVDEGVEPDAAVVKEIDKKLKLWRAKYLAKTPAADDAGDAQKAAKRRKSEQSRQDMIAAEEDALG

SEQ ID NO: 192 - DNA, 1244 bp, Drosophila melanogaster
cacgagctcgtgccgattcggcacgagcggcacgagctctctctctctctctctctctctctctctctctctctcgcaagatgtatcctgtgagctcgcaaaagaggtcctggacattcgccaatgagggccagctcatggagttccgcgtggagcagaacagcaagtacatcgagtcgcacgaggaggaggcgcagggtcgcgacctcaatgagcactttctcacgtcggcggaggagcgcctgttgctgaagcagtacgagatctacctgttcgatttctgccgccgcttcgaaccgacgatgcccaagtgcgttgtgggcacggccttccactacttcaagcggttctatctgaacaactcccccatggactatcaccccaaggagattctagccacatgcgtgttcgttgcctgcaaagttgaggagttcaacgtgtccatcaaccagttcgtgaacaacatcaagggcgacaggaacaaggccaccgacatagtgttgtccaatgaattactgctgattggacagctcaactactacctcaccatacacaatccgttcagacccatcgagggtttcctgatagatataaaaactcgcagcaatatgcagaatccagatcgtctgcggccacatattgatagtttcattgattccacgtactactcggatgcctgtcttctgcatacgccttcgcaaattgcattggctgccgtcctccacgcggccagcagagagcaagagaatctcgatagctatgtgacggatcttctgtttgtctccgccagggagaagctacccggactcatagatgccgtgcgaaaaattcgcataatggtgaagcaatatcagcagcccgatcgggagaaggtcaaggccatcgagaaaaagttggacaagtgccgaaatcaagccaataatcctgatagcgaactctataaggagcgcctacgccgattgtacaccgatgaggatgacatgcccgccgaagatgcctcattccacattgcagatgtgagctcggacacatctgctatgaacatcagccaatagacttaagaatatttatttaaatgatgggatgatctactactgcgtggatttcatcgatattaaagcattttgtaatttaccatttcttgattgttaaaatgtatgcgtttagtgttagtttactaaacaaagttggattaggtacttcacttttccaatatataaaatattaaaaaaaaaaaaaaaaaa

SEQ ID NO: 193 - protein, 324 aa, Drosophila melanogaster
MYPVSSQKRSWTFANEGQLMEFRVEQNSKYIESHEEEAQGRDLNEHFLTSAEERLLLKQYEIYLFDFCRRFEPTMPKCVVGTAFHYFKRFYLNNSPMDYHPKEILATCVFVACKVEEFNVSINQFVNNIKGDRNKATDIVLSNELLLIGQLNYYLTIHNPFRPIEGFLIDIKTRSNMQNPDRLRPHIDSFIDSTYYSDACLLHTPSQIALAAVLHAASREQENLDSYVTDLLFVSAREKLPGLIDAVRKIRIMVKQYQQPDREKVKAIEKKLDKCRNQANNPDSELYKERLRRLYTDEDDMPAEDASFHIADVSSDTSAMNISQ

SEQ ID NO: 194 - DNA, 1150 bp, Homo sapiens
cacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaataaaccat

SEQ ID NO: 195 - protein, 323 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 196 - DNA, 1311 bp, Phaeodactylum tricornutum
atggtagactacgacgacagcactcagctcaacaaatggctcttccagtcaactgacgaactcgagctttgccgagcgcgggcaaacaatgaagcgaggacttttctgaccaactcgccaggggaagaaccgctgttgttgtcgtccgagacagccgcaactccaaccgagactcaaccgctaccggtaaagcacttcgcgtatggttttcgccaggatttgcaaacaaatcctgttgtctctgactcatatcgagaagggccgttggagaatgatgacgggcacgctttcttgactcctgtggaagaagccacgctggtgtccttctacgcgtcgaaattacccagtctgattggcccgaacgctagcgtttctcgcctacgacgcgaatccaaagtaccagctactgccgcactcttgtaccgccgcttttttctgtccaattctgtgttactgtacgaccccaaggtcatcatggtggcagccgcatttctgggaagcaaagtggaagacgcaacggctgacgtccggtatctcgaggaaggtaccgccctcatgaacgctcctgtatcacaggccgaaataattccagcggaactgaatctgctatcagggacttactttgacttgctttgctttcatccctacaagactgttctggccttgacggaagatttgcggacctatctgaagtccgacaagggacaagcgctggtatcatggccgccgaccacggccgctgacgacgacgacgtgaacgtcccagctccccttttgagcggacaggacttgaaacccatgtacgaggctgcccgggctttggtagacgactgtgttgtatcggacatccctctactgtacacaccaggtcaagtgggtctagcagccctcatggttgcgcaggccgagctacttgttcgcagtcgaggcaacggcgccagtaaccagaagtcacgaataccccaaattgacctggaaggctacgtccggcaacgttttgatacagacgaaacacgcgaaatttccatggacacttttttggcaacgttgcgaacacttcaaacacagttacaaggcttgcgagaaggccaacttggatgttacaacaatcccagcgtcattgatatgcaagctctcaaggctatacacaaaaaactgaaaaaggttcgagcctggggaacgtcgggcagtggggggaaaagtgaaaaaaagaaaaagaagcgcggctcgcctgcaggcggcggtacggccaacgcggtcgatagtggcgaaccggagcggaagaaaatgaaagcgtccggagcccagtga

SEQ ID NO: 197 - protein, 436 aa, Phaeodactylum tricornutum
MVDYDDSTQLNKWLFQSTDELELCRARANNEARTFLTNSPGEEPLLLSSETAATPTETQPLPVKHFAYGFRQDLQTNPVVSDSYREGPLENDDGHAFLTPVEEATLVSFYASKLPSLIGPNASVSRLRRESKVPATAALLYRRFFLSNSVLLYDPKVIMVAAAFLGSKVEDATADVRYLEEGTALMNAPVSQAEIIPAELNLLSGTYFDLLCFHPYKTVLALTEDLRTYLKSDKGQALVSWPPTTAADDDDVNVPAPLLSGQDLKPMYEAARALVDDCVVSDIPLLYTPGQVGLAALMVAQAELLVRSRGNGASNQKSRIPQIDLEGYVRQRFDTDETREISMDTFLATLRTLQTQLQGLREGQLGCYNNPSVIDMQALKAIHKKLKKVRAWGTSGSGGKSEKKKKKRGSPAGGGTANAVDSGEPERKKMKASGAQ

SEQ ID NO: 198 - DNA, 1254 bp, Arabidopsis thaliana
gttacacgaattattaaaacctaatcattgattatttattcctgaccttgtttcttctccttccatcacctaattataatcagacctaaactagctaattacaacactccactactactactactacaactcttctgatgttgactttgtacggtcaagaaaggtcaccggagaactccaccacaagtacgaccgatgcttccgatcgccgggatgagacgccgtcgtcggagatagtcgtgagagatattcacgcgatgacgacgacgacagagcttactcggccacaacaaaggggatcaggaggaggatacttgtctccgtcgaggtctattgcttttagcgacggaactacttcttccggtgagaatttcaccaccgtgagcagagagttcaacgctctagtcatcgccggatcttccatggacaacaacagtaacggaactaaccaatcaggtggtcatcgtgacgtcatacgtgatgaaagaaacgagctgactaggatcggcgaaaacgatgacgttggtgatcatggtcaggtgcctgaggaggattcaaatccatgggcgattgtaccggacgattacaacaaccgggacggttcagagaataatattgtgttggcgtcatcaggtggtcagaaccggatggtgacgactgcttcggtgcagagggtgaagagagaagaggtggaagcaaagataacggcgtggcaaacggcgaaggtggctaagattaataataggtttaagagacaagacgccgttattaacggttggttgaatgagcaggttcatagagctaactcttggatgaagaaaatcgagaggaaactggaagataggagagcgaaggcgatggagaaaacacaaaacaaagtggcaaaagctcagaggaaggcggaggagaggagagccacggcggaaggtaaacgagggacggaggttgcgagggttcttgaagttgctaatctcatgagagccgttggacgacctccggccaaacgatcattcttctctctttcctagctaagctattactagttttagttacatccaaatgtctcaatatatataggctaccattttctgttgggaatcaatgtgtatataactatatatagaatgtaagagttttaaaggtactgatatattttgtaattgtatgcttttttctttgtctgcaccacataaaaactaataaaatgttatttgtaagccaagaaaattgtttacatgtattgttttgtcattc

SEQ ID NO: 199 - protein, 296 aa, Arabidopsis thaliana
MLTLYGQERSPENSTTSTTDASDRRDETPSSEIVVRDIHAMTTTTELTRPQQRGSGGGYLSPSRSIAFSDGTTSSGENFTTVSREFNALVIAGSSMDNNSNGTNQSGGHRDVIRDERNELTRIGENDDVGDHGQVPEEDSNPWAIVPDDYNNRDGSENNIVLASSGGQNRMVTTASVQRVKREEVEAKITAWQTAKVAKINNRFKRQDAVINGWLNEQVHRANSWMKKIERKLEDRRAKAMEKTQNKVAKAQRKAEERRATAEGKRGTEVARVLEVANLMRAVGRPPAKRSFFSLS

SEQ ID NO: 200 - DNA, 923 bp, Arabidopsis thaliana
aaaataaaaacagttaatctctctaaaacaattttttgttttctctctctcttaaataaccagagagttcagaatcattttgattctctttgtaatctttagttgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcatttggagaagaaaaaagcagagtatgtggagcagatgaagaacaaaatagctcaaattcacaaggaagcagaagagaagagagcaatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtattgatgtaatgacgttctttagtttgcttaatgtgggtttaatatggcaacatagaaagttataaggtcaacatcttatattgattggggtgcgtttgttaattatttaatttgtatttgtacatctttccattgaaaggctttctcttagcttt

SEQ ID NO: 201 - protein, 202 aa, Arabidopsis thaliana
MAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEHLEKKKAEYVEQMKNKIAQIHKEAEEKRAMIEAKRGEEILKAEELAAKYRATGTAPKKLFGCM

SEQ ID NO: 202 - DNA, 878 bp, Arabidopsis thaliana
ggaaataatatcttcaatttttcatatttcgtttttaatttggttttcttttttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaaaatatgtttcattgttttctttccgc

SEQ ID NO: 203 - protein, 212 aa, Arabidopsis thaliana
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 204 - DNA, 2356 bp, Arabidopsis thaliana
cgagtgattgatattttattatagatttaatacacacccgacactctgtcaattctataggcatacgagctcactccaaatttagattcagttttttaatacgaactttttagttaagccaagattagcaataatatagatcatttattttcttgattgtagtttgattgttgtttttctcataataaaaaaatcccagctaaaatctgattttcaattttaaaccaatttatatggtaaacaaaattttagttcggtataattggaagaattaagttttgttgaatatcaggaaaaaagaaggggaggacaaattttctacagaggtgacgtggcatcattgaaccactttacttgtcggcagtgaggtgtgtttaatcacgtgtaacgcatccaatgcgtatgagagctttacagccgcacgatcacatgggtacaaaaatcaacggcgaagcaaaacaagagtctcacacttattaaagccacgtagcactccaccggtataagctaacggaggatataaaaactctttaactcattattgtcctaaaatctcaattttatccattttcacggaaaaaacataaaatctgttcttcttcttcggctgagagacaatggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaagtaagctttctatttacatacgtgtgtgttttatatatgttaatcttctacttaggaggattcattcatgtttacgatgaattattatagtatgtaattcagaattcttacgtttggaactaaggtttcaatttacaattaacaaatggattttcttaagatgcctaaggtttttgtgagttcttttgcatatgacttggtctatactctatttgtttaggtgaaatccatcgctgttagaatttacaacttcatcatggtattttcaagagaattatgtttttcgaggatgatattattaaaatatgattaatagtaaagcaatgttccctgtaattagtgttatcaaaaagtgtatggaatcatgacaaattagttgtggacagctatgaattaaggaaagtgggttactttcttaatattcctacattttttccttcctttaaagttgcttaactcttggaaaataacgattaagtactaactttccagcagtttttataatccttgaacattcatttgttcatctttatttactatatgtaattccttctgtgtggagtttcgttttataaactactattttgatgaccttattagccaattagagcaacaaaatttaacttagttaaaagtgagcttcttgcaacaaatatccatgtgttatacttataagtgtgcttcttgcagaacccatcgaggagcatacacctaagaaagcttcatctggttcggccgatagaggtcagctgataacaacactttgtttctcatgtccagtttcttagttacttagttcagtaatttacttcaaatgtgtgttgtgtgtgtttggtcagatgtgatacttgccgacttggaaaaagagaagaaaacgtcattcatcaaagcatgggaagagagtgagaagtcaaaggctgagaacaggtaaactttcatcatcttctcacccaaagattactattgcttacagatctctgatgatcttgaaatgagcagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcgaagctgaagaaatgggtgctaagtatagagccactggtgtagtaccaaaggcaacgtgtggatgtttctaagcctttattgaatttgtatctttgtaacaattcatctctgtttctttcttcttcttttgtttttgtgtgattcaacaactctttttagtttttgttatttgtttggtcgtttgtgtcttgtttacatattgggtgattgtgtgtaaaagtgaaagattaatggagtataattgtatgaagcatcaaatcttgttttgccttttgtttcagttgtacgacttcacatctgatctgtaactcttaaaatgctaagacacttgacttgacacacaccaactataatccttaaacagttcaggcacaggtgga

SEQ ID NO: 205 - protein, 190 aa, Arabidopsis thaliana
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLEAEEMGAKYRATGVVPKATCGCF

SEQ ID NO: 206 - DNA, 642 bp, Arabidopsis thaliana
atggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaa

SEQ ID NO: 207 - protein, 202 aa, Arabidopsis thaliana
MAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 208 - DNA, 969 bp, Arabidopsis thaliana
aacgagaaacagaacatcactaccaaacatctccagctcagtttcttcaaataaaaacagttaatctctctaaaacaattttttgtttctctctctcttaaataaccagagagttcagaatcattttgattctctttgtaatctttagttgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttat

SEQ ID NO: 209 - protein, 202 aa, Arabidopsis thaliana; identical to SEQ ID NO: 207

SEQ ID NO: 210 - DNA, 959 bp, Arabidopsis thaliana
acagaacatcactaccaaacatctccagctcagtttcttcaaataaaaacagttaatctctctaaaacaattttttgttttctctctctcttaaataaccagagagttcagaatcattttgattctctttgtaatctttagttgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttat

SEQ ID NO: 211 - protein, 201 aa, Arabidopsis thaliana
MAEEEPKKVTETVSEPTPTPEVPVEKPAAAADVAPQEKPVAPPPVLPSPAPAEEKQEDSKAIVPVVPKVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 212 - DNA, 609 bp, Arabidopsis thaliana
atggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtga

SEQ ID NO: 213 - protein, 202 aa, Arabidopsis thaliana; identical to SEQ ID NO: 207

SEQ ID NO: 214 - DNA, 528 bp, Arabidopsis thaliana
atgactttagaggagcagaagaaagtcataatgcccgaggccgtcgcatcggagccatcaccaccatccaaggaggagaagtccgacgattcgaaagctattgttctcgtcgtcgctgcaaaagaacctacggaagacaagaaagtaggttcagttcaccgagatgctgttttggttagactcgagcaagataagaggatatctctaatcaaagcttgggaagaggctgagaaatccaaagtggagaacaaagctcagaagaagatttcttcagttggagcttgggaaaacagcaagaaagcttctgtggaagctgagctaaaaaagatcgaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctga

SEQ ID NO: 215 - protein, 175 aa, Arabidopsis thaliana
MTLEEQKKVIMPEAVASEPSPPSKEEKSDDSKAIVLVVAAKEPTEDKKVGSVHRDAVLVRLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTKLFGFF

SEQ ID NO: 216 - DNA, 847 bp, Arabidopsis thaliana
aactcattattgtcctaaaatctcaattttatccattttcacggaaaaaacataaaatctgttcttcttcttcggctgagagacaatggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaagcctttattgaatttgtatctttgtaacaattcatctctgtttctttcttcttcttttgtttttgtgtgattcaacaactctttttagtttttgttatttgtttggtcgtttgtgtcttgtttacatattgggtgattgtgtgtaaaagtgaaagattaatggagtataattgtatgaagcatcaaatc

SEQ ID NO: 217 - protein, 190 aa, Arabidopsis thaliana
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 218 - DNA, 351 bp, Arabidopsis thaliana
atggagccaaatattccgatccaaagaggtaactcatatcacagagttttagtattgtttagtttcatgttgactcagaagaagctactagatatttcaggatgggagaaaaagaaaactacaaagatcgaatctgaactcgctagaattcagcggaagatggacagtaagaagatggagaaatctgagaaactaaggaacgaaaaagcggcagttcatgcaaaggcacaaaagaagaaggcagatgttcaaaccagacgggctcaagagatccttgatgcggaagaagctgctgctaggtttcaagccgcaggaaagatacccaagaagtcatctttgagctgcttctga

SEQ ID NO: 219 - protein, 116 aa, Arabidopsis thaliana
MEPNIPIQRGNSYHRVLVLFSFMLTQKKLLDISGWEKKKTTKIESELARIQRKMDSKKMEKSEKLRNEKAAVHAKAQKKKADVQTRRAQEILDAEEAAARFQAAGKIPKKSSLSCF

SEQ ID NO: 220 - DNA, 609 bp, Arabidopsis thaliana; identical to SEQ ID NO: 212

SEQ ID NO: 221 - protein, 202 aa, Arabidopsis thaliana; identical to SEQ ID NO: 207

SEQ ID NO: 222 - DNA, 485 bp, Arabidopsis thaliana
tcattctcaatcaaatggagccaaatattccgatccaaagaggagatgagcagtcaaaagttattaaggcatggaaggaactaaagataacaaaggtcaataacaagactcagaagaagctactagatatttcaggatgggagaaaaagaaaactacaaagatcgaatctgaactcgctagaattcagcggaagatggacagtaagaagatggagaaatctgagaaactaaggaacgaaaaagcggcagttcatgcaaaggcacaaaagaagaaggcagatgttcaaaccagacgggctcaagagatccttgatgcggaagaagctgctgctaggtttcaagccgcaggaaagatacccaagaagtcatctttgagctgcttctgagatcagcactaacctgtgatacagattatcacctatctccggtatcctatgttcatacttgtatcttttgtatgttgtgtgttttgcttgtgttgctca

SEQ ID NO: 223 - protein, 123 aa, Arabidopsis thaliana
MEPNIPIQRGDEQSKVIKAWKELKITKVNNKTQKKLLDISGWEKKKTTKIESELARIQRKMDSKKMEKSEKLRNEKAAVHAKAQKKKADVQTRRAQEILDAEEAAARFQAAGKIPKKSSLSCF

SEQ ID NO: 224 - DNA, 363 bp, Arabidopsis thaliana
atgaacgaatccacagtgcaacgagcgaaacctgaacatatggcagctgttgtggatcaatggaaggaaacagagataagcaaatcgagaaagaagtacgagaagctaagtgagaagattgtgtcatgggaagataagaagaggaaaaaggcaaagagaaaacttcatagaacagagagaagtgtagagaaaacaaagttgaaggcgacccagaggttcagggacgaaaatgaacgtattgagattatcgttgcaagtgcaagagcacatgcgtatgagagtcgaataaaagaagagttgaaggttaaggagaaagcaaacctcatgagaacaactggtaggaaaccctctacatgcctctga

SEQ ID NO: 225 - protein, 120 aa, Arabidopsis thaliana
MNESTVQRAKPEHMAAVVDQWKETEISKSRKKYEKLSEKIVSWEDKKRKKAKRKLHRTERSVEKTKLKATQRFRDENERIEIIVASARAHAYESRIKEELKVKEKANLMRTTGRKPSTCL

SEQ ID NO: 226 - DNA, 1299 bp, Arabidopsis thaliana
ttaatgtcacatttctgaaatctctcaacttcatcatcaagtgggttcctatgagagtgacgactctttgattgcttcgccacatcttttatttttatccttctaagtcatttctctatctatccatatagataaaaaccttctaatagatctctgtgtcattttattcgtaagaatgagatctagtgtagaagataacaaaggatggataggaccagcgacaccggagatatcgaacggttttgagtttcagaaaggttcgaaccggacaccaaaccatcaccggtctactatggggaagccagcgccgtcaaaatgggacgatgctcagaaatggctttctggtgtagggtttgctcgtggaggtggtggaggtggtgacaagagtagtcatcactcaagaagtaataagccgagaaactcgaacgcggatgatcttagacttatagcttcagcttcacagagagaacgtgaaggagaagatcagtacgttgagtatgatgatgaagagatggcggcgggaagaccggaggttgagacgaagaatgttgattgtggtgaatctgtttggaggaaagaaagtagtattaatccaacggctgtgattagatccgtttgtgtgagagatatggggactgagatgactcctattggtagtcaagagccttctagaacagctacaccggtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctatggaagctcgagccatggcttgggatgaagcagaacgtgctaaattcatggctaggtataagagagaggaagtgaagatacaagcttgggagaatcacgagaagagaaaggctgagatggagatgaagaaaatggaggtaagatgcggagaggatgaaagcaagggcagaggagaagttggccaacaagctagctgcgacgaaaaggatagcggaagagaggagggcgaatgcggaggctaagttaaacgaaaaggcggtgaagacatcggagaaagctgattatataaggaggagtggtcacttgccttcttctttttctttctcctttaagcttccctctcgttgttggtgtcaataattgtctattttcattagaatgtaatcgtatggatttagtgatattcaataactaacgcaaaaaaaaaaaaaaaagtttt

SEQ ID NO: 227 - protein, 308 aa, Arabidopsis thaliana
MRSSVEDNKGWIGPATPEISNGFEFQKGSNRTPNHHRSTMGKPAPSKWDDAQKWLSGVGFARGGGGGGDKSSHHSRSNKPRNSNADDLRLIASASQREREGEDQYVEYDDEEMAAGRPEVETKNVDCGESVWRKESSINPTAVIRSVCVRDMGTEMTPIGSQEPSRTATPVRATTPVGRSPVTSPVRASQRGEAVGVVMETVTEVRRVESNNSEKVNGFVESKKAMSAMEARAMAWDEAERAKFMARYKREEVKIQAWENHEKRKAEMEMKKMEVRCGEDESKGRGEVGQQASCDEKDSGREEGECGG

SEQ ID NO: 228 - DNA, 1298 bp, Arabidopsis thaliana
ttaatgtcacatttctgaaatctctcaacttcatcatcaagtgggttcctatgagagtgacgactctttgattgcttcgccacatcttttatttttatccttctaagtcatttctctatctatccatatagataaaaaccttctaatagatctctgtgtcattttattcgtaagaatgagatctagtgtagaagataacaaaggatggataggaccagcgacaccggagatatcgaacggttttgagtttcagaaaggttcgaaccggacaccaaaccatcaccggtctactatggggaagccagcgccgtcaaaatgggacgatgctcagaaatggctttctggtgtagggtttgctcgtggaggtggtggaggtggtgacaagagtagtcatcactcaagaagtaataagccgagaaactcgaacgcggatgatcttagacttatagcttcagcttcacagagagaacgtgaaggagaagatcagtacgttgagtatgatgatgaagagatggcggcgggaagaccggaggttgagacgaagaatgttgattgtggtgaatctgtttggaggaaagaaagtagtattaatccaacggctgtgattagatccgtttgtgtgagagatatggggactgagatgactcctattggtagtcaagagccttctagaacagctacaccggtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctatggaagctcgagccatggcttgggatgaagcagaacgtgctaaattcatggctaggtataagagagaggaagtgaagatacaagcttgggagaatcacgagaagagaaaggctgagatggagatgaagaaaatggaggtgaaggcggagaggatgaaagcaagggcagaggagaagttggccaacaagctagctgcgacgaaaaggatagcggaagagaggagggcgaatgcggaggctaagttaaacgaaaaggcggtgaagacatcggagaaagctgattatataaggaggagtggtcacttgccttcttctttttctttctcctttaagcttccctctcgttgttggtgtcaataattgtctattttcattagaatgtaatcgtatggatttagtgatattcaataactaacgcaaaaaaaaaaaaaaaagtttt

SEQ ID NO: 229 - protein, 347 aa, Arabidopsis thaliana
MRSSVEDNKGWIGPATPEISNGFEFQKGSNRTPNHHRSTMGKPAPSKWDDAQKWLSGVGFARGGGGGGDKSSHHSRSNKPRNSNADDLRLIASASQREREGEDQYVEYDDEEMAAGRPEVETKNVDCGESVWRKESSINPTAVIRSVCVRDMGTEMTPIGSQEPSRTATPVRATTPVGRSPVTSPVRASQRGEAVGVVMETVTEVRRVESNNSEKVNGFVESKKAMSAMEARAMAWDEAERAKFMARYKREEVKIQAWENHEKRKAEMEMKKMEVKAERMKARAEEKLANKLAATKRIAEERRANAEAKLNEKAVKTSEKADYIRRSGHLPSSFSFSFKLPSRCWCQ

SEQ ID NO: 230 - DNA, 792 bp, Arabidopsis thaliana
atggataatttggttaagcaaagaagaagaagggtctcaatctctgagaacataaaaacggatttgccaatgctatcagaattggacataacagattacccagcattaaactggctgaaaaaccaatcatattggtacgagaaaaatgactactacaacgagaaagagagtgaattggcagtttctgttgcggttgctgcattcgtcattagatcaatggaagaagccgataaacaaaaatcgaaaagaataagagaagaaatcaagaggtcaaggaccaaaaaatccaatctggttatacctaatacccaagtaaagaggttaagcaaatcatatacacaagaggtgaaaattggagaggagagtttcagaaaaaaattgttggagtatccatcagaaaaccgtcggccacaagagattggctcatcctccggaacatcaggacttgcttcagcgtcaagtaaagcagattcttgggaaaaatctcaaatcaagaaaataagattaaggtatgagaaaatgaaagctgatattgtgggttgggagaatgagagaaaattagcagctacactgttaatggagaaaagaaagagtgaattggagaagagaaaagggattaataatcagcattataagtcaaaattagcaaggattcaactaatagctgatggagccaagaaacagcttgaggagaagagaaggagcaaagaagctcaagttcatggaaaagtaaagaaaatgagtcgaacagggaaagttcctaataattatttctgctttcggtgttactaa

SEQ ID NO: 231 - protein, 263 aa, Arabidopsis thaliana
MDNLVKQRRRRVSISENIKTDLPMLSELDITDYPALNWLKNQSYWYEKNDYYNEKESELAVSVAVAAFVIRSMEEADKQKSKRIREEIKRSRTKKSNLVIPNTQVKRLSKSYTQEVKIGEESFRKKLLEYPSENRRPQEIGSSSGTSGLASASSKADSWEKSQIKKIRLRYEKMKADIVGWENERKLAATLLMEKRKSELEKRKGINNQHYKSKLARIQLIADGAKKQLEEKRRSKEAQVHGKVKKMSRTGKVPNNYFCFRCY

SEQ ID NO: 232 - DNA, 1495 bp, Arabidopsis thaliana
gtctcgtttgttttgctctttagaaattaccgatttacgctgaaaaaatgtgaaaaatacaatcgatcgcattatctttatccctagctaatcattcatgtacaagcatgtctccgaaggttaaaagcagtcgctatttaccggaccaacgtagttttctcgaagtggtggtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcatgtgtggttttgtacttttcttagttacacacaccatacaagaaaaaaagaagattataattcaacttaattttgatttttgaataatgcgtttgtataagaagtcaaataaaaaattcgtttctactttctacc

SEQ ID NO: 233 - protein, 274 aa, Arabidopsis thaliana
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIERKLEERKAKAMEKTQNNVAKAQRKAEERRATAEAKRGTEVAKVVEVANLMRALGRPPAKRSFFSFS

SEQ ID NO: 234 - DNA, 1038 bp, Arabidopsis thaliana
atggataccttaatcaagcagacaaggaggaagcatccagcttcccaggaaaaaattagagaggttggtagctcaactagagagaaaaaagtgtcagcaaggaagtctgtttcattcaaagaagataagaagaagccttcaaactggttacagaagcagttctcgaggcaaatgagtggccaaagttatgatcccatcggagaaatggatcatgcagctgcagttgcagccactgcctatgccatagccacttttgaagaaacttggctagagaactatcatagtggccttgaacttggaccttcttcgtcaaggagcaagagcagaagtgaagaactgttgcctttagaggaaccaagaagcttatcaagaagattctcagggcaactttcgtttatagattcagagacgaaagatcataaacctcctacactaaagtccccaatgagaaagtcatcttcggtaaaaaagactttctccatgaacttgatgggagaccacaccaaacagaatcaagattcagaggagaaacatgaaagacaaagaaaaccggtttctgaaccaccacggatacaaccaccgcttaggacacgatcagaacctcgtgctccaccgccacctcctcctcctcttctatcaccttcgcctctgcggcttccacctagggaaaccaaaaggcagagttctgagcatactagtcgaaaggatgattctacagctgatgcttgggaaaaagctgaactatctaagatcaaagcaaggtatgagaagttaaacagaaagatagatttgtgggaagcgaagaaaagggaaaaagctcgaaggaagctggacatatctgagcagagcgaactagaacagaggagaaagagaggtttgcagagatttagagaagacacagaatacattgaacagattgctgctggagccagagctcaggcggagaaagacagacagagcaaagagttcaaggtgaaggagaaggccggtgttatccgtagtaccggtaaactccctggaaatgcatgctgtttctga

SEQ ID NO: 235 - protein, 345 aa, Arabidopsis thaliana
MDTLIKQTRRKHPASQEKIREVGSSTREKKVSARKSVSFKEDKKKPSNWLQKQFSRQMSGQSYDPIGEMDHAAAVAATAYAIATFEETWLENYHSGLELGPSSSRSKSRSEELLPLEEPRSLSRRFSGQLSFIDSETKDHKPPTLKSPMRKSSSVKKTFSMNLMGDHTKQNQDSEEKHERQRKPVSEPPRIQPPLRTRSEPRAPPPPPPPLLSPSPLRLPPRETKRQSSEHTSRKDDSTADAWEKAELSKIKARYEKLNRKIDLWEAKKREKARRKLDISEQSELEQRRKRGLQRFREDTEYIEQIAAGARAQAEKDRQSKEFKVKEKAGVIRSTGKLPGNACCF

SEQ ID NO: 236 - DNA, 1284 bp, Arabidopsis thaliana
atgagaaagacttctgtttcatctaatagctttggtgggtttttaagtcccggagctccgagttacgctgacaacaaaggttggagctccgagagagttcctcatccttcctccactacttcctcctctgcaattaacggtggtcgtcgtcacatcggctcttcttccgctttaacgacgccgttttacagcggcagagcaattccttcgaaatgggaagatgctgagcggtggatttgtagccctgtgtcgacttacccacaaggtgtttgtttaaattcctcagtgagttctgaacagagaaggcagaaatctaaaagtggtccgattgttcctcctacgttgcctcatccgcatcctacgtcttcttcgtcggcgactgggtgttatcactattctccgaggatgatgatgcggtctatggatgctcctcctaagggtttaatggttgctggttctccgttttctactggagttttggaggcggatagggtttttagaggaagtgtcggtggtggtggttgtgatggctatggtcgtggacctggccatggacatagccggagctgggttgatttgatgagtgaagaaacttcttcacttagctccaaaactgatacagaggagaaagcagagatgacgacggcgatgcaatctccggtggtatcaagaagagatatggctactcagatgagtccagaagagacgagtcctaataacaataaccagtctccaccattggttgtttctgtgattgagccacctccttgtagaggtgaagtgagagaagtgaaaatggataaaggagcaagaatgattaagcgtccaaagagacgagtcatgtcttctaggattattaggagagagcaacctgaggttgaagacaattctgaagcttctgcttcttcttcttcttgggatatctcagaaccagccatgactctttctaagttgcaaagagaggaagcgaagattgcagcttgggaaaatctgcagaaggcgaaagcagaagccgctattagaaaacttgaggtgaagctggagaagaagaaatcagcatcaatggataagatcttgaacaagcttcaaacagctaagatcaaagcacaagagatgaggagaagttcagtatccagtgaacatgaacaacaacaagggaatcatcaaatctccagaaactcggtgaagatcacgcatcttgttcgaagacatactttcatgactcctttcatgacttgctttgctcctcgtgttgattgcagaaaatcttcttctgctctctga

SEQ ID NO: 237 - protein, 427 aa, Arabidopsis thaliana
MRKTSVSSNSFGGFLSPGAPSYADNKGWSSERVPHPSSTTSSSAINGGRRHIGSSSALTTPFYSGRAIPSKWEDAERWICSPVSTYPQGVCLNSSVSSEQRRQKSKSGPIVPPTLPHPHPTSSSSATGCYHYSPRMMMRSMDAPPKGLMVAGSPFSTGVLEADRVFRGSVGGGGCDGYGRGPGHGHSRSWVDLMSEETSSLSSKTDTEEKAEMTTAMQSPVVSRRDMATQMSPEETSPNNNNQSPPLVVSVIEPPPCRGEVREVKMDKGARMIKRPKRRVMSSRIIRREQPEVEDNSEASASSSSWDISEPAMTLSKLQREEAKIAAWENLQKAKAEAAIRKLEVKLEKKKSASMDKILNKLQTAKIKAQEMRRSSVSSEHEQQQGNHQISRNSVKITHLVRRHTFMTPFMTCFAPRVDCRKSSSAL

SEQ ID NO: 238 - DNA, 1421 bp, Arabidopsis thaliana
caacagtggtagaaacaaaacaaaagaaaactccatggacttcacaagaaacagcaacaccaagctccatccccaaactcagcttctgtttccccctaatatggagaaaaactcaaatgttagcgccaacccatttgcagaagactcacttacaagcagaatcaatctaaaggaaactacagatttcatcaagtcacttccaatttcatcaaaccaaagcagtagtagcagcaatgagatggtaaacgagagaagaccaagtttctcatcacaaaagagcattggagaaggaagaagcaatggacaaagaagattgatgttaatggagtctccttgtactccaggtagaggagtcttcagtttcagtagcaatgtctctggtagaagaagaaacttcccttctaaatggattgatgctgagaaatgggtcacttcctctggtcatgactctccagcacattctctcaaaaacaaccaatttgatgggtttaaacaccaggtggaagttgtatactcagagaaatctagggttacagaagaatgtttccatggatctgtctcattatctccacaagatcttatccttaaagataagttagcaaacgaagttcctcagattcttccatcaacggaagggtttatattcaaagattccgacaagtttctccggtacgaggaagctcaagttcaacacagagacatgggaacagagatgacaccaataggaagtgtaacgacttcaagatgtcacacgccgtttaaaagttcctctccagcgagacacaacacgccttctcaattgtctggtccgttaacggaaaccaaaaacgttatagatatatccgagttcgaagacaagcttagactcagtgggtcatcaacgagtcagtattgttactcggtgacgagtcattggaactcgagagaagaagaagaagaagagatatcgaagagtttaagacatttcgatatggagagtgagttaaggagaagtgtgtctgaatctaaagctcctttatgggatgatgaagacgacaagatcaagttttgtcaaaggtatcaaagagaagaggccaaaattcaagcatgggttaatcttgaaaacgctaaagccgaagctcaatctagaaagcttgaggtgaaaatacagaagatgagatcaaatttagaggagaaattaatgaagagaatggatatggtgcaccggagagcagaagattggagagctacggcgaggcagcaacatgttgagcagatgcagaaagcggccgagacggcgaggaaattgacaaaccgccgaggctatttggttaccggccgtagctcatgtggttgtctaccttgcaataatacttgtcattaactcagtcaaagtaaaagagagtaaaatacacataaacaaacacaagaaattactgttt

SEQ ID NO: 239 - protein, 442 aa, Arabidopsis thaliana
MDFTRNSNTKLHPQTQLLFPPNMEKNSNVSANPFAEDSLTSRINLKETTDFIKSLPISSNQSSSSSNEMVNERRPSFSSQKSIGEGRSNGQRRLMLMESPCTPGRGVFSFSSNVSGRRRNFPSKWIDAEKWVTSSGHDSPAHSLKNNQFDGFKHQVEVVYSEKSRVTEECFHGSVSLSPQDLILKDKLANEVPQILPSTEGFIFKDSDKFLRYEEAQVQHRDMGTEMTPIGSVTTSRCHTPFKSSSPARHNTPSQLSGPLTETKNVIDISEFEDKLRLSGSSTSQYCYSVTSHWNSREEEEEEISKSLRHFDMESELRRSVSESKAPLWDDEDDKIKFCQRYQREEAKIQAWVNLENAKAEAQSRKLEVKIQKMRSNLEEKLMKRMDMVHRRAEDWRATARQQHVEQMQKAAETARKLTNRRGYLVTGRSSCGCLPCNNTCH

SEQ ID NO: 240 - DNA, 1734 bp, Arabidopsis thaliana
ccattttgtctctcttcttctttttcagagacagaggaattagagaaagcaagctttgtgtctgtaaatataaagagatagagaaaagatttggcattggcaatggattacgagaggatacagaaagtgcagaagagtataatctcgccaacgaagctgagaatgaagctaatgggtccactcaataacatgaagcgagaaggatccaagtccaacagtaactcttcaagaacatctccttctcgtcttcagattccagatgactccgagttctccaagaacagcttgttagcttctaactcttattcagacgacgatgtggcagctacaactacggatatagaagtagctaagctgccaaatgagccggttttgtatccaaccgagaacgataatcaaggctcaaaagatcggtgtgaaggtgttgttccaagggaaaatgatcagcctagactgcagcaatttaggaaaggggacttgaatatggcttctcctcatataatgagacctcaagaagatgaaaaccttgattatgacagtaacgctagctcttcaagcttcgagtttcaccgagctcgtggtgagcgttcgaatcagaatcatggctcaagaggatatccttcaagacaaatgccatctaaatggaatgatgctgagaagtggataatgagcagacagaacatggtgatgaggaagaacggtcaagggaaccgaatacctgtgagaattgtgcctgataatgcaggttacgagcataacaaatctaggatggatctgtgccaatcctcacaagttgatgggtttgagaagttccctaatgttgttccctcggcgccacatcctattctaactcaagagtatggaggagactcgttgattgaccaatccacacaaagcaatgatcttgcggattcatcacatgatcatacaacaggtggtcctgcgattcgttcggtatgtatgagagatatgggaaccgaaatgacacctataccgagtcaagaaccttcaagatctgtgacaccagttggtgcaacaactcctcttcgtagcccgacttcatctctcccttctactcctagaggtggccaaccagaggaatcttctatgtcgaaaaacacaagaagagaactatctgaggaggaagagaaagcgaagacgcgaagagagattgtagctcttggagttcagctagggaagatgaacatcgccgcttgggcaagtaaagaagaagaggagaacaagaaaaacaatggagatgcagaggaggcacagaagattgagtttgaaaaacgagcgactgcatgggaagaagcagagaaatccaaacataatgcgaggtataagcgtgaggaaatcagaatccaagcttgggaaagtcaggagaaagccaaactcgaagcagaaatgcgacgtatagaggctaaagttgagcagatgaaagctgaagctgaagcaaagataatgaagaaaattgcgttggctaagcaaaggtcagaagagaaacgggctttggcggaagctagaaaaacccgtgatgctgagaaggcagtggctgaagcccaatatattcgggaaactggtagaataccggcatcaagttacaagatatgttgtggttggttctcatgaggcattggattgagtttttggtcttctgagtaaaccatgattggattctcaaagcccctttgtgtaatatagaaatggaatgcatattatgttgcatagact

SEQ ID NO: 241 - protein, 509 aa, Arabidopsis thaliana
MDYERIQKVQKSIISPTKLRMKLMGPLNNMKREGSKSNSNSSRTSPSRLQIPDDSEFSKNSLLASNSYSDDDVAATTTDIEVAKLPNEPVLYPTENDNQGSKDRCEGVVPRENDQPRLQQFRKGDLNMASPHIMRPQEDENLDYDSNASSSSFEFHRARGERSNQNHGSRGYPSRQMPSKWNDAEKWIMSRQNMVMRKNGQGNRIPVRIVPDNAGYEHNKSRMDLCQSSQVDGFEKFPNVVPSAPHPILTQEYGGDSLIDQSTQSNDLADSSHDHTTGGPAIRSVCMRDMGTEMTPIPSQEPSRSVTPVGATTPLRSPTSSLPSTPRGGQPEESSMSKNTRRELSEEEEKAKTRREIVALGVQLGKMNIAAWASKEEEENKKNNGDAEEAQKIEFEKRATAWEEAEKSKHNARYKREEIRIQAWESQEKAKLEAEMRRIEAKVEQMKAEAEAKIMKKIALAKQRSEEKRALAEARKTRDAEKAVAEAQYIRETGRIPASSYKICCGWFS

SEQ ID NO: 242 - DNA, 2020 bp, Arabidopsis thaliana
atgccgtcggagtcatcgtacaaagtccaccgtccggcgaaatccggaggatctcgacgagactcaagccccgactcaataatcttcacacctgaatctaatctcagtctcttctcctccgcttccgtcagcgtcgatcgttgctcttccacctccgacgctcacgaccgggacgactctctcatctccggtccctctctggagcgagatcagagggtaagttcgagctgtaaagatctagatctagacaagcgtggtacagggtggaagaatagttgtaactctagaaaatcaaataaagtaaaagcagcttggaaagaggagtttgaggttaaaaaagatgatgaaagccagaatcttgattcagctaggagttctttctctgtagctcttagagaatgtcaggaacgaagatctagatctgaagcgctggcgaaaaagttagattaccaaaggactgtttcgttggatcttagtaatgtaacctctacgtctccaagagtggtaaatgtgaagagagcttcagtttcaactaataaatcgagtgtgtttcctagtcctggtactccgacttatctacatagtatgcaaaagggttggagttcagagagagtacctttacgttcaaacggaggaagaagtccgccaaatgctgggtttttacctttgtatagtggtagaacggttccttctaagtgggaagatgcggagagatggatagttagtcctcttgctaaggaaggagctgcccgtacttcatttggagcatcgcatgaaaggcgacctaaagcaaagagtggtccattaggtcctccaggatttgcatattattcgttgtattcccctgcagttcctatggttcatggtggaaacatgggaggcttaacagcaagctctccgttttcagctggtgtgttgccagaaactgtttcttctaggggttccactacagctgcctttcctcagcgaatcgatccatccatggcgagatcagttagcattcatggctgctctgaaacacttgcatcttcatcccaagatgacatccatgaaagtatgaaggatgctgctaccgatgctcaagctgtctcaagaagggatatggcaacccagatgagtcccgagggaagcatccggttttcccctgagagacagtgttcgttctctccctcctctccatcaccactacctatttcggaactactgaatgctcattccaaccgagcagaagtcaaggacttacaggttgatgagaaggtaaccgtaactcgctggtcaaagaagcacagaggtctataccatggaaatggctcaaaaatgcgagatcacgtacatggaaaagctactaaccatgaagatttgacatgtgcgacagaggaagccagaattatatcttgggaaaatttgcagaaagctaaggccgaggcagcaataagaaagctagagaaatatttcccacagatgaagctggaaaagaaaagatcatcgtcgatggaaaagattatgagaaaagtaaaatcagcagagaagagagcggaggagatgaggaggtcggtgttagacaatagagtctcaaccgcatctcatggtaaggcttcatcattcaaaagaagtgggaagaagaagatcccttcccttagtggttgcttcacctgccatgtattctagttgccctttttcgaagaaaatacggtaaatggagactcttcactgatgcgtacgcgtaatatttggctttctaattcctgcttgtaatactactttcgatagtcagtagctgttaattgatttcaatagatgcgcttagtacatttgtatgttagttcctagctgagtaaaatccgagggatgagtccacccatttccacctttgttggtctcttcgggtgtttagaggtgaattgatcccaagaggacaaactcttcttgataaaatgtatttgtaatttatgatgccttgatactaacattatgacataactttttttaacattatgacaaacattgttgttttacattc

SEQ ID NO: 243 - protein, 555 aa, Arabidopsis thaliana
MPSESSYKVHRPAKSGGSRRDSSPDSIIFTPESNLSLFSSASVSVDRCSSTSDAHDRDDSLISGPSLERDQRVSSSCKDLDLDKRGTGWKNSCNSRKSNKVKAAWKEEFEVKKDDESQNLDSARSSFSVALRECQERRSRSEALAKKLDYQRTVSLDLSNVTSTSPRVVNVKRASVSTNKSSVFPSPGTPTYLHSMQKGWSSERVPLRSNGGRSPPNAGFLPLYSGRTVPSKWEDAERWIVSPLAKEGAARTSFGASHERRPKAKSGPLGPPGFAYYSLYSPAVPMVHGGNMGGLTASSPFSAGVLPETVSSRGSTTAAFPQRIDPSMARSVSIHGCSETLASSSQDDIHESMKDAATDAQAVSRRDMATQMSPEGSIRFSPERQCSFSPSSPSPLPISELLNAHSNRAEVKDLQVDEKVTVTRWSKKHRGLYHGNGSKMRDHVHGKATNHEDLTCATEEARIISWENLQKAKAEAAIRKLEKYFPQMKLEKKRSSSMEKIMRKVKSAEKRAEEMRRSVLDNRVSTASHGKASSFKRSGKKKIPSLSGCFTCHVF

SEQ ID NO: 244 - DNA, 1652 bp, Arabidopsis thaliana
ctgtactttcacaagcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgttgctagtggattagatgattgcaaagatgttgatgttgtgagtgagattactgattgttctacttcagggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgttgttaattctcaagaacacatctttctatcatcatttgtataataaaagctttgaaaaacttatttcttgtgatct

SEQ ID NO: 245 - protein, 486 aa, Arabidopsis thaliana
MDYERIGKTQVTSSGGGFSPGKLRSMLLLGVDRKKNEEEESTPTMRSGSNQIDDPRVYVASGLDDCKDVDVVSEITDCSTSGIARSISLGLQEYSDYDNVNEIKSVSASSVFEFQKTEKEKVNQRMPIRSFSKPAPSKWDDAQKWIASPTANRPKTGQVQVPGSKKGPSFGRQSSMKIVEVAEHRVVEEPDTKRIDVSQVKKDMGNKFGSWEVDSYTTVDSYVKPVLMVENSIVESATEVNLSRHDSSVATAFAQPPSTARSVSMRDMGTEMTPIASQEPSRNGTPIRATTPIRSPISSEPSSPGRQASASPMSNKELSEKELQMKTRREIMVLGTQLGKFNIAAWASKEDEDKDASTSLKTKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPSLLFSCFSFCS

SEQ ID NO: 246 - DNA, 351 bp, Arabidopsis thaliana; identical to SEQ ID NO: 218

SEQ ID NO: 247 - protein, 116 aa, Arabidopsis thaliana; identical to SEQ ID NO: 219

SEQ ID NO: 248 - DNA, 636 bp, Arabidopsis thaliana
atgaagactaaccggaaccgtccgatcaacatcctcatcgtcttcttccttcttacgaccgcaagagcagcaacaagaaactggaccaaccgaactcaccgaaccgtccctaaggttcaacacgcgtactacgcatatcctcaccgttcatgcgaatctttctctcgtccatacgcacgctctatgtgcattgagctcgaaagaatccacagaagcagtcgacaaccgcttttctctcctccgcctcctccgacggagattgatcaaagcgtcatgaacgaatccacagtgcaacgagcgaaacctgaacatatggcagctgttgtggatcaatggaaggaaacagagataagcaaatcgagaaagaagtacgagaagctaagtgagaagattgtgtcatgggaagataagaagaggaaaaaggcaaagagaaaacttcatagaacagagagaagtgtagagaaaacaaagttgaaggcgacccagaggttcagggacgaaaatgaacgtattgagattatcgttgcaagtgcaagagcacatgcgtatgagagtcgaataaaagaagagttgaaggttaaggagaaagcaaacctcatgagaacaactggtaggaaaccctctacatgcctctga

SEQ ID NO: 249 - protein, 211 aa, Arabidopsis thaliana
MKTNRNRPINILIVFFLLTTARAATRNWTNRTHRTVPKVQHAYYAYPHRSCESFSRPYARSMCIELERIHRSSRQPLFSPPPPPTEIDQSVMNESTVQRAKPEHMAAVVDQWKETEISKSRKKYEKLSEKIVSWEDKKRKKAKRKLHRTERSVEKTKLKATQRFRDENERIEIIVASARAHAYESRIKEELKVKEKANLMRTTGRKPSTCL

SEQ ID NO: 250 - DNA, 537 bp, Arabidopsis thaliana
atgaagactaaccggaaccgtccgatcaacatcctcatcgtcttcttccttcttacgaccgcaagagcagcaacaagaaactggaccaaccgaactcaccgaaccgtccctaaggttcaacacgcgtactacgcatatcctcaccgttcatgcgaatctttctctcgtccatacgcacgctctatgtgcattgagctcgaaagaatccacagaagcagtcgacaaccgcttttctctcctccgcctcctccgacggagattgatcaaaggtacgagaagctaagtgagaagattgtgtcatgggaagataagaagaggaaaaaggcaaagagaaaacttcatagaacagagagaagtgtagagaaaacaaagttgaaggcgacccagaggttcagggacgaaaatgaacgtattgagattatcgttgcaagtgcaagagcacatgcgtatgagagtcgaataaaagaagagttgaaggttaaggagaaagcaaacctcatgagaacaactggtaggaaaccctctacatgcctctga

SEQ ID NO: 251 - protein, 178 aa, Arabidopsis thaliana
MKTNRNRPINILIVFFLLTTARAATRNWTNRTHRTVPKVQHAYYAYPHRSCESFSRPYARSMCIELERIHRSSRQPLFSPPPPPTEIDQRYEKLSEKIVSWEDKKRKKAKRKLHRTERSVEKTKLKATQRFRDENERIEIIVASARAHAYESRIKEELKVKEKANLMRTTGRKPSTCL

SEQ ID NO: 252 - DNA, 639 bp, Arabidopsis thaliana
atggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaa

SEQ ID NO: 253 - protein, 212 aa, Arabidopsis thaliana; identical to SEQ ID NO: 203

SEQ ID NO: 254 - DNA, 528 bp, Arabidopsis thaliana; identical to SEQ ID NO: 214

SEQ ID NO: 255 - protein, 175 aa, Arabidopsis thaliana; identical to SEQ ID NO: 215

SEQ ID NO: 256 - DNA, 771 bp, Arabidopsis thaliana
atgacgacgacgacagagcttactcggccacaacaaaggggatcaggaggaggatacttgtctccgtcgaggtctattgcttttagcgacggaactacttcttccggtgagaatttcaccaccgtgagcagagagttcaacgctctagtcatcgccggatcttccatggacaacaacagtaacggaactaaccaatcaggtggtcatcgtgacgtcatacgtgatgaaagaaacgagctgactaggatcggcgaaaacgatgacgttggtgatcatggtcaggtgcctgaggaggattcaaatccatgggcgattgtaccggacgattacaacaaccgggacggttcagagaataatattgtgttggcgtcatcaggtggtcagaaccggatggtgacgactgcttcggtgcagagggtgaagagagaagaggtggaagcaaagataacggcgtggcaaacggcgaaggtggctaagattaataataggtttaagagacaagacgccgttattaacggttggttgaatgagcaggttcatagagctaactcttggatgaagaaaatcgagaggaaactggaagataggagagcgaaggcgatggagaaaacacaaaacaaagtggcaaaagctcagaggaaggcggaggagaggagagccacggcggaaggtaaacgagggacggaggttgcgagggttcttgaagttgctaatctcatgagagccgttggacgacctccggccaaacgatcattcttctctctttcctag

SEQ ID NO: 257 - protein, 256 aa, Arabidopsis thaliana
MTTTTELTRPQQRGSGGGYLSPSRSIAFSDGTTSSGENFTTVSREFNALVIAGSSMDNNSNGTNQSGGHRDVIRDERNELTRIGENDDVGDHGQVPEEDSNPWAIVPDDYNNRDGSENNIVLASSGGQNRMVTTASVQRVKREEVEAKITAWQTAKVAKINNRFKRQDAVINGWLNEQVHRANSWMKKIERKLEDRRAKAMEKTQNKVAKAQRKAEERRATAEGKRGTEVARVLEVANLMRAVGRPPAKRSFFSLS

SEQ ID NO: 258 - DNA, 1044 bp, Arabidopsis thaliana
atgagatctagtgtagaagataacaaaggatggataggaccagcgacaccggagatatcgaacggttttgagtttcagaaaggttcgaaccggacaccaaaccatcaccggtctactatggggaagccagcgccgtcaaaatgggacgatgctcagaaatggctttctggtgtagggtttgctcgtggaggtggtggaggtggtgacaagagtagtcatcactcaagaagtaataagccgagaaactcgaacgcggatgatcttagacttatagcttcagcttcacagagagaacgtgaaggagaagatcagtacgttgagtatgatgatgaagagatggcggcgggaagaccggaggttgagacgaagaatgttgattgtggtgaatctgtttggaggaaagaaagtagtattaatccaacggctgtgattagatccgtttgtgtgagagatatggggactgagatgactcctattggtagtcaagagccttctagaacagctacaccggtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctatggaagctcgagccatggcttgggatgaagcagaacgtgctaaattcatggctaggtataagagagaggaagtgaagatacaagcttgggagaatcacgagaagagaaaggctgagatggagatgaagaaaatggaggtgaaggcggagaggatgaaagcaagggcagaggagaagttggccaacaagctagctgcgacgaaaaggatagcggaagagaggagggcgaatgcggaggctaagttaaacgaaaaggcggtgaagacatcggagaaagctgattatataaggaggagtggtcacttgccttcttctttttctttctcctttaagcttccctctcgttgttggtgtcaataa

SEQ ID NO: 259 - protein, 347 aa, Arabidopsis thaliana; identical to SEQ ID NO: 229

SEQ ID NO: 260 - DNA, 825 bp, Arabidopsis thaliana
atgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaa

SEQ ID NO: 261 - protein, 274 aa, Arabidopsis thaliana; identical to SEQ ID NO: 233

SEQ ID NO: 262 - DNA, 1071 bp, Arabidopsis thaliana
atggataccttaatcaagcagacaaggaggaagcatccagcttcccaggaaaaaattagagaggttggtagctcaactagagagaaaaaagtgtcagcaaggaagtctgtttcattcaaagaagataagaagaagccttcaaactggttacagaagcagttctcgaggcaaatgagtggccaaagttatgatcccatcggagaaatggatcatgcagctgcagttgcagccactgcctatgccatagccacttttgaagaaacttggctagagaactatcatgtaacggtttttaaaaacagagtttttgttagaagtggccttgaacttggaccttcttcgtcaaggagcaagagcagaagtgaagaactgttgcctttagaggaaccaagaagcttatcaagaagattctcagggcaactttcgtttatagattcagagacgaaagatcataaacctcctacactaaagtccccaatgagaaagtcatcttcggtaaaaaagactttctccatgaacttgatgggagaccacaccaaacagaatcaagattcagaggagaaacatgaaagacaaagaaaaccggtttctgaaccaccacggatacaaccaccgcttaggacacgatcagaacctcgtgctccaccgccacctcctcctcctcttctatcaccttcgcctctgcggcttccacctagggaaaccaaaaggcagagttctgagcatactagtcgaaaggatgattctacagctgatgcttgggaaaaagctgaactatctaagatcaaagcaaggtatgagaagttaaacagaaagatagatttgtgggaagcgaagaaaagggaaaaagctcgaaggaagctggacatatctgagcagagcgaactagaacagaggagaaagagaggtttgcagagatttagagaagacacagaatacattgaacagattgctgctggagccagagctcaggcggagaaagacagacagagcaaagagttcaaggtgaaggagaaggccggtgttatccgtagtaccggtaaactccctggaaatgcatgctgtttctga

SEQ ID NO: 263 - protein, 356 aa, Arabidopsis thaliana
MDTLIKQTRRKHPASQEKIREVGSSTREKKVSARKSVSFKEDKKKPSNWLQKQFSRQMSGQSYDPIGEMDHAAAVAATAYAIATFEETWLENYHVTVFKNRVFVRSGLELGPSSSRSKSRSEELLPLEEPRSLSRRFSGQLSFIDSETKDHKPPTLKSPMRKSSSVKKTFSMNLMGDHTKQNQDSEEKHERQRKPVSEPPRIQPPLRTRSEPRAPPPPPPPLLSPSPLRLPPRETKRQSSEHTSRKDDSTADAWEKAELSKIKARYEKLNRKIDLWEAKKREKARRKLDISEQSELEQRRKRGLQRFREDTEYIEQIAAGARAQAEKDRQSKEFKVKEKAGVIRSTGKLPGNACCF

SEQ ID NO: 264 - DNA, 540 bp, Oryza sativa
atggagacccaggaggcgaagagagcagatgtggcggcggcgccggcgacggcgaccggcggtgaggccgtcaaaccggccgccggcgatgctggcgcagtaaccaagacgaatggaccttcagcaccagcaggcaaagctgcaactccaacgggttcggttgacagagacgccatactcgcaaacgtggagctggagaggaaactgtcaatgatcaaggcgtgggaggagagcgagaagagcaaagcggagaacaaggctcagaagaagatgtcatccatactctcatgggagaacacgaggaaggcagctatagaagcaaaactgcgaacacaagaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctag

SEQ ID NO: 265 - protein, 179 aa, Oryza sativa
METQEAKRADVAAAPATATGGEAVKPAAGDAGAVTKTNGPSAPAGKAATPTGSVDRDAILANVELERKLSMIKAWEESEKSKAENKAQKKMSSILSWENTRKAAIEAKLRTQEEKLERKKAEYAEKMRNQVAAIHKAAEEKRATVEATRHEEIIKYEEMAAKHRSKGTTPTKFLSCFGS

SEQ ID NO: 266 - DNA, 612 bp, Oryza sativa
atggccggggaggcattgaaggaggcgggggcgacgcccgccgcagcgaacgcgggggaggagaaggccgtcatcccggcggcttcgacatcgccggtgatctccaagaccgatgatgacacggagccgccggccgatgactccaaggctctcgtcgtcttcgtcgagaaggttgctgataaacctcatgctgagaaggcaacagcaacagcaacaccaacaaggacctcaaatgacagagatattgcccttgcaaaggtggagacagacaagcgagaatcgttgatcaaagcatgggaggagaacgaaaaggcaaaagcggagaacagggcctctaagaagttattggatattatttcatgggagaacacaaagaaggcagtaataaaaactcaactgaaaaagaaggaagaagagttggaaaggaagaaggcagagtacgctgagaaggcgaagaacaaggaagcaatcgtccataaggaagctgaagaaaagagagcaatggtgatggcccggcgcggtgaagaagtgatcaaggccgaggagatagcagctaagtaccgtgcaaccggagtgacaccgaagaaacatatcgggtgttttggggcataa

SEQ ID NO: 267 - protein, 203 aa, Oryza sativa
MAGEALKEAGATPAAANAGEEKAVIPAASTSPVISKTDDDTEPPADDSKALVVFVEKVADKPHAEKATATATPTRTSNDRDIALAKVETDKRESLIKAWEENEKAKAENRASKKLLDIISWENTKKAVIKTQLKKKEEELERKKAEYAEKAKNKEAIVHKEAEEKRAMVMARRGEEVIKAEEIAAKYRATGVTPKKHIGCFGA

SEQ ID NO: 268 - DNA, 1013 bp, Oryza sativa
acatcatccctccgcgcaaaagcctatcaacagctaagccaaacagggtcaggagccggagccgtccgggagagggaacactcgagcgatccgtccgtccgcccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttctttt

SEQ ID NO: 269 - protein, 206 aa, Oryza sativa
MAEEEAKKVEVEVTEAPPAAAAAAETEPAAKDVAEEKAVIPAPAPPAEEEKPPVDDSKALAIVEKVADEPPAEKPAQGGSNDRDVALARVETEKRNSLIKAWEENEKTKAENKASKKLSAILSWENTKKANIEAQLKKIEEQLEKKKAEYAEKMKNKVAIVHKEAEEKRAMVEAKRGEEVLKAEEMAAKYRATGHAPKKLIGCFGA

SEQ ID NO: 270 - DNA, 1021 bp, Oryza sativa
agttcgtgtgcttctctcatttgttccttgatatatttgctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatgatgctgagaaagctgcagcaacaggtggctcacacgaaagagacgctctcctgacgacggtcgccacggagaagaggatatcgctgatcaaggcgtgggaggagaacgaaaaggccaaggccgacaacaaggcggccaagaagttggccgacatcgcctcatgggagaactccaaggtggccgagatcgaggccgagattaagaagtaccaagtaagttcagctcagctaagttcatcaacaagcagaacaaggagagatcaattatgtgtgtgtgaatcattgagttgatcgatcggttcatatatatgcaggagtacctggagaggaagaaggcggagcaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtcgtcgtcgtcgttgttgtaaatgtgtgtgcgacagtgtgagtgtaccggtgtcaagttcagatagctagtggttggatgtattttctcagttgtttgttttcgtttaatttcatgtacagggcagctattgcagtctcatgtgaaaaagggaacatttattatgtacagacatgatgttttggggtctttattcggattcggcggtgaaattgtaacatttttgtgcctgtggtacttggctagtactcatgtataagaggcttacccatttgacattatt

SEQ ID NO: 271 - protein, 153 aa, Oryza sativa
YICYVVRELVQIASLAELLEMAEVAPPAPAPEPTKDIAEERAAVPAPEESKAMTVVDDAEKAAATGGSHERDALLTTVATEKRISLIKAWEENEKAKADNKAAKKLADIASWENSKVAEIEAEIKKYQVSSAQLSSSTSRTRRDQLCVCESLS

SEQ ID NO: 272 - DNA, 981 bp, Oryza sativa
gcttccactcttctcctccacctccaagaaccccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 273 - protein, 262 aa, Oryza sativa
MLGSDQLEHRPAPSAPRAEPDDVADDVEVEAFRDIHPEPSPPHLPPPPLRQPSWDAASHRSLSSSGAGGGGDVELFATMSREFTAMVAAGSSSAPSPDVPGDAPAAADLNLLQLARIGENEPAAEANALAIVPAAAGSGPPAPVEQVKKEEVEAKVAAWQAEEVAKINNKFKREEVVINGWESQQVDKATAWLAKIERKLEEERAKATEKARNEAAAARRKAEERRASAEARRGRKTAEVLDRANFCKAAGRVPSKRSFFSF

SEQ ID NO: 274 - DNA, 1031 bp, Oryza sativa
cgttgtccatcacaattgctaattaactaagacacccttccttgattgtgacactagcacgacgcactttcctctatatacatatacatatatcctccttctgtccagctaacggtttatatgcttagctagctgtttgttttggcgataccatttgcattgcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgacgaagctgttcgggctcttgaaagcctgagagaaatcatgaggagttcatcatacatatatgctgggatttggtgttgttgattagtctgtgaacttacagaaatttgtatatgtgcaatgcatggcatccgtgtttgcgtcgtgtgtatgtcgtctaattgaagggccatttggtttgtattttgtcagttgggtggtttgatttctggtgcgttttgtaaaggaattgtgtatatgcataggggagtgcaggcaggggatgatggattatgaatacgcttattctttcatg

SEQ ID NO: 275 - protein, 175 aa, Oryza sativa
MAEEAKKVEVTKDIAEEKAVVPLPTPPATEHDDSKAIVLVKEAEATGGSAERDAYLAKIVSEKRLVLINAWEESEKARAENRAAKKLSYITSWENAKKAEMEAELKRIEQELEKKKAAYEEKLKNKLALLHKTAEEKRALTTAKRGEELIMAEEMAAKYRAKGEAPTKLFGLLKA

SEQ ID NO: 276 - DNA, 1526 bp, Oryza sativa
accactcaccaccacagctcagctcggagaagcgaagaggaggaagaagagcaagacgccgatggttacgcgtgtgtgctagtggctgagcactagcggcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgccgacgccgacgccgagccagccgtcgtcgtcgtaccaccggcggaggagggagtcgtgggagtccgcggcggggagcaggcacacgtcgatccgctccgtggggagcgacaccgccccaagtgagctcttccctactatgagcagggagttctcggccatggtcgccgcagcagccaacgccaacgccgccgccgccgcagccgcgaacggcggcgactccagccgcgccggggtggacgacgcgctggggaggatcggggaggatgagctcgaggagacgaacccgctcgccatcgtcccggacagcaaccccatcccgtcccctcgccgcgcccacctcgcgctccccgcccccggcgacgtgtcgtcggcgggcggcggccacggcgacgaggtgtcggtggggcaggtgaagaaggaggaggtggagtccaagatcgccgcgtggcagatcgccgaggtcgccaaggtcaacaaccgcttcaagcgcgaggaggtcgtcatcaatggctgggagggcgaccaggtcgagaaggccaacgcctggctcaagaagtacgagaggaagctggaggagaagagggccaaggcgatggagaaggcgcagaacgaggtggcgaaggcgcggcggaaggcggaggagaagcgggcgtcggcggaggcgaagaggggcaccaaggtggcgcgcgtgctggagctcgccaacttcatgagggccgtggggagggcgccatccaagcgctccttcttctgagcgaccgcgccaccctcttcccctcctcctcctcctctctgctttgctcgccgccgtcgccgtcgtcgtcgtcgccggcgccggcggctgatcgttcaccgcttcgcttcacacgcagggatcagtgctgtgatgtggttgctgtgtggaactctcgttttagtgttgtatccacatgtatgatgtactgtcatcatatcctctcttttttttctttttttcttgttctctttactttcttgtgcttgataagggtattgcaaagttgggagggacagacagaacaagtaaatagcataagttggatggtgctctgccccttatagcttatggtgagggggacaagagctgcctgtaatttgttttttgtcatcatcaaggattgtgtatgtcaatatgaacaagatatggagctacctgttttgtgt

SEQ ID NO: 277 - protein, 316 aa, Oryza sativa
MLSEQTAASGSSSSSRGADDREIVISTGREIVVRSSGGEEREEEVVVEEELEEPEFRDIHALSPPPTPTPSQPSSSYHRRRRESWESAAGSRHTSIRSVGSDTAPSELFPTMSREFSAMVAAAANANAAAAAAANGGDSSRAGVDDALGRIGEDELEETNPLAIVPDSNPIPSPRRAHLALPAPGDVSSAGGGHGDEVSVGQVKKEEVESKIAAWQIAEVAKVNNRFKREEVVINGWEGDQVEKANAWLKKYERKLEEKRAKAMEKAQNEVAKARRKAEEKRASAEAKRGTKVARVLELANFMRAVGRAPSKRSFF

SEQ ID NO: 278 - DNA, 1234 bp, Oryza sativa
gcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctc

SEQ ID NO: 279 - protein, 284 aa, Oryza sativa
MLHEQHAPPPQPEPEVSLQLSAPATAADDVAAGDDEEVTVVTTYRDIHPLTPPSPTTTTTPPTRLGSAAYSWDTASSHRSVSSEEQFMTMSREFTAMVAAGTTMQTGPNDGNNGGDQLTSIGEDELEETNPLAIVPDSHPIATPARSRASQLEVVPAAGPSPAPPVEARQVKKEEVETKVSAWQTAEVAKINNRFKREEVVINGWETEQVEKASAWLKKIERKLDEQRAKALERTQNDIAKARRKAEEKRASAEAKRGLKLAKVLELANFMKAVGRVPTKRSFF

SEQ ID NO: 280 - DNA, 717 bp, Oryza sativa
atggacggcgacttgaagaagctaagggttcgatttcctggattaggaaagggaaacaaaggtggcagacaggctccaacaatactgcaagaagaagacacatctcttcaaagagccaatgtatctgtaaggaggccacttaaaccagcacaaagaaagcaagaggacatagcttcagatcagaaggtgccacccaagatggttgattcttctctgagcgcgaagaaaggttcgggttcctctagcaaattgcaagacaagaaagggagcaagaagtttgagcaagagcaggtgattcagaagaccccatccaccacaaggccagcaacatcgtatcattctagacggaatggagatggtactgttggattaactgctgttggcccagcagacaccaaaactaatgaatgggagaaggcgaagctcgctagcattacggaagagtataagaacatgatggataccatagctgaatgggagaatgagaagaaggtgaaggctaagcgccaaaaagagcaaaaagagaaagtgttggaccaaaagagagcaaaggcactagaagaatacagccaggaaataacaaggatcaacaaaattgctggaggagcaaggacaatggcagaggaaaggaaatataacgatgagaaaaagatcaaagaaaaggcaaataaaagacggttatcggaaaaggctccccgcgcatgcgcttgcttttaa

SEQ ID NO: 281 - protein, 238 aa, Oryza sativa
MDGDLKKLRVRFPGLGKGNKGGRQAPTILQEEDTSLQRANVSVRRPLKPAQRKQEDIASDQKVPPKMVDSSLSAKKGSGSSSKLQDKKGSKKFEQEQVIQKTPSTTRPATSYHSRRNGDGTVGLTAVGPADTKTNEWEKAKLASITEEYKNMMDTIAEWENEKKVKAKRQKEQKEKVLDQKRAKALEEYSQEITRINKIAGGARTMAEERKYNDEKKIKEKANKRRLSEKAPRACACF

SEQ ID NO: 282 - DNA, 1242 bp, Oryza sativa
ggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttccc

SEQ ID NO: 283 - protein, 340 aa, Oryza sativa
MRRSSQGKSSSGGGVGGVRRYDVHGGGNLLACYAKAARPRPSKWDDAQKWLSRAGDDDCGGEATRRRSSCASADDGLLLPPPPAARKGAGGWRSWSNVEWEGAPAAMAPALKAARGDEGVDTKVVDAVQAYVPQRCVVSLRDVGTEMTPGGSKEPSRANTPRVVAPAATARVVARGTASPGQCDGGSRDSAVAGGVVDLRAARKRADQGHDEVAGTITAVSPATAWGDAERAKYMARYRREEMRIQAWENRERRKAELQMRTAEEKAERMRLRAQARTAGKLATAQAEAKARRARAEAELALGRPGGGAKGWLLTRSASWSSGSGRSPSSLSLRLPLLCR

SEQ ID NO: 284 - DNA, 1653 bp, Oryza sativa
aacgtttgcttcctctctagaaatcaaggggagggcaccgccaccggaagagggcaagaagaacggcgagaagatggcggccgccgccgcgatcccgatcccgatcccctgcgtcgcggagcccaccgcggcgtcccgcgtctcgccgggctcgtcccccgcccgctccgacgcctccgagggcgccgcgttctacgccgccgacaccgaggccgagccggaggcgtccgtcgggaggagcacgcagatgctgctcgcgatggccgccatgggcggccgcggggggccctacggccgccgcccggcgtcttcctacggcagctgcgccgcgtggagcgccgggtcgctcaccgaccaccgccccgcctcgccgtccccaatctgcagccccgtgagcagcaatggaggggagggctgccgcgacggtgatgacgcctcctcgttcgtcacgccacggctggaagaagaccaagaaaggctgccaaacagaggagatttcataaatccgtctaccacaccacgacacatcagactgcaaacgcccagacaaccttcccttctggataggagatttgagagaactaatccagtgccaccaagattcatccacaaggccacgccagctagattgatgcgccgagctcgctcctcacataattaccgtaggcgtttgggggcaatggatgctatcaatgaatggagattgcccaaagtcagtgaagaagaggatgaagcagtggatcaaacggattggcaggctgatactctgtcttctcgtatatcctcagctcgtgattggaactttgaggctggtggtgcctatgagggaagtgatcataatggcggtgcgtttaaccattcagatggcgaaaatagcccagttgcagtgcaaagaatggggagatggccccagggttctgcggtaaaacataaggaaaattttgtccacgccaagttggttgcctggaagaatgcggagattgaaaagctcatagacaagctgagaaggaaagaggccgatatcgatgaatggcagatgaatcaggttacacaggcaaaggagaagatgaaaagaattgagatcaagttggagaagaagagagcgagagcagcagagaagatgcaaaaggcaataaaagatgcacaaaagaaagctgataagaagaaaatcaaggagcatgcagcaaccgacaatcagatagctagtgttgagagagcaatggtgaagatgtctaggacaggaaagctcccctggtcactggcttttctgtaaacgagttcttcacttgtggtagatccaagcaagccgattgttttgaaacctcttgccgagatgccagcacggagagactaaaatgagcgcacatgctgtcagtactcagaagcagtgccaactactgaaatcagaaaatttgttgtatataatagcagtggtttgtcgtccttagatgatagaagtttcaggctgtatacctgattggcatttgaacactgttcttaaacatgacacgaacagtcagggccaaattatagtactttcccttctgttgtggtttcaagtactgttctcaggcacaacattatttccccagtaggatttggatgtacatgtacagtggcaaactgacaagtttcttgttttggtatgatctg

SEQ ID NO: 285 - protein, 399 aa, Oryza sativa
MAAAAAIPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDGDDASSFVTPRLEEDQERLPNRGDFINPSTTPRHIRLQTPRQPSLLDRRFERTNPVPPRFIHKATPARLMRRARSSHNYRRRLGAMDAINEWRLPKVSEEEDEAVDQTDWQADTLSSRISSARDWNFEAGGAYEGSDHNGGAFNHSDGENSPVAVQRMGRWPQGSAVKHKENFVHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWSLAFL

SEQ ID NO: 286 - DNA, 1578 bp, Oryza sativa
actaaccacactataatacggtacaaatagatcatatatacactagcatagcacgaaatcgcaaagtccactaacatcccactcccccttccaagcttcttgtctcctctcctctccccaactcccacgccatctcgccaccaccaaccgattcaggccgcgcacgccattaatggagtacgagcgcatccacggccccccgctccaacgtcagtcgggtggattctccccagctaagctacgagcaatgcttctcggactagagaaaaatcagcacaacggggaggacacatcgcctgaggccaacgattccggcgagctggacgaccagaggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttgctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtttcagagggaagaggtaaagattcaagcttgggaaaaccaccagaaagcaaaaattgaagctgaaatgaagaggatggaggcaaagatagagatcaagagagctcgcgagcaggacaggctttcgagcaagttggcagctgcaaggcacaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcc

SEQ ID NO: 287 - protein, 423 aa, Oryza sativa
MEYERIHGPPLQRQSGGFSPAKLRAMLLGLEKNQHNGEDTSPEANDSGELDDQRSMECSTSTEMSSNSGHRSRNRAQDDDSFDSESSSSGPPTVKRPAAVTALLPPFSRPTPSKWDDAEKWISSPTANRGGRVGSAAGAAPKKSALAFPEHVSRPPAVAKVVAEVPINTGTLVKNSVALAQPISFNPAQSASIVDEPAPAVRSVSMRDMGTEMTPIASQEPSRTGTPIIASSPTSSRTPTPQRNAEISIGEFGPNKMEMSEEELQMNTRKEIMDLGQRLGKTTIAAWASKEEKSTTSFANVITDKAVEIDREARAADWEEAEKAKYLARFQREEVKIQAWENHQKAKIEAEMKRMEAKIEIKRAREQDRLSSKLAAARHKAEARREAAESRKNQEAARTEEQAAQIRKTGHIPSSISCWCWCL

SEQ ID NO: 288 - DNA, 1873 bp, Oryza sativa
agcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctgttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaagatttaaacgagaagagattaagatccaagcatgggaagatcatcagagagcaaaaatcgaagctgaaatgagaaaaattgaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgc

SEQ ID NO: 289 - protein, 510 aa, Oryza sativa
MEYERIEKPFPTQGGGFSPKRLRAMLLGVEKRRKGQEEEEEGDAGEVDDEYGAVPKSSVRSDADSDARRGGSMCEEYKDVDVVSTISESSSSLETGSGHRSRDTHSMGSRVRVPEEDSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWAPPDPYPEVETCAKSALAEEITVADSAVTFSRHDSSATLQSATTCIPPPPTVRSVSMRDMGTEMTPIASQEPSRTGTPVRATSPDCSRPTTPRKTIGPNAIGAVIGHGECSNVELSEQELQMKTRREIMLLGTQLGKTNIAAWASNKEEEKDASLSLKGVPMDQSTQKVTEIRAAAWEEAEKAKYLARFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 290 - DNA, 1108 bp, Oryza sativa
aggcatgcagatgtctgtacagttaataatgctggtgtcacctcagagtatcaaacaaaggcaaccgataacagttcatcaattgaaataaggccctacaaagatcccaaagctattcctgcagttcattcggtgtccgtgagagatgtgggcacagaaatgactcccataccgagtcaggatccttcaaggacaggaactccacttggatcaatgacaccaactcgtagcccaaattgctctataccatcaactcctgtaggaggacggtcaacagcatcaccaggagatgacaacacagatgatggaccatatttcaacagaaaaggtggcacaaatgaaatatcagacgatgaaatgagattgaagacaaggaaagaaattgccgccctgggtatacaactaggaaagatgaacattgctacatgggctagcaaagaggagctagaactagtctctgcatccccaagcattgctgatttggagcggatgaagaaagaatatgcagctcgtgcagcagcatatgaagaagcagaaaattttaagcatacagcaagattcaagaaggaagagttgaagattgaagcatgggagagccttcaaaaagcaaaaatagaatctgaaatgaagagaatagaggaacatgcagagaaattgcgaagcgaagccatggcgaagatggctgaaaagctagaaatgacacggcgtttagctgaagagaaacgagcctcagccaatgcaaggatgaaccaacaagcagcaaaggcggttcacaaggctgagctgattcgccagacaggacgagttccagggtcatgtatcctatgctgcagtggttgcttctgtcaacactagtgtatgcttgacaattagggagttaaatatggtcgtgaaaaatctaaaccccatgttctataatcagcattccttggttttagtatggaaaggaatgtctgatactttgattaggtattcagatgtacaaattcttgcttgtcataaaagtcaatccaatgcttacatttgcttggtcggctactcggttaaagaacacttggttgttgctcaacgaattgaatcattggaaaatgacgagcatttcttgact

SEQ ID NO: 291 - protein, 284 aa, Oryza sativa
RHADVCTVNNAGVTSEYQTKATDNSSSIEIRPYKDPKAIPAVHSVSVRDVGTEMTPIPSQDPSRTGTPLGSMTPTRSPNCSIPSTPVGGRSTASPGDDNTDDGPYFNRKGGTNEISDDEMRLKTRKEIAALGIQLGKMNIATWASKEELELVSASPSIADLERMKKEYAARAAAYEEAENFKHTARFKKEELKIEAWESLQKAKIESEMKRIEEHAEKLRSEAMAKMAEKLEMTRRLAEEKRASANARMNQQAAKAVHKAELIRQTGRVPGSCILCCSGCFCQH

SEQ ID NO: 292 - DNA, 1452 bp, Oryza sativa
aaagcacaacactcgcagccattctgctttgctttgctgcttcttcctcctccctccctgcttctttgctttcttgctaatttgcaggtaactagaggtagtacagtttagcaagctcaaagctgagagagagagaggggttataatctgtcatggagtacgagaggatacacaaagttcagatgggagtgatgtctccaaccaagctgaggatgaagctgctgggatcccatggcggcagcatcggcagggttgacgaggcaaagaagtcgccgcgagcgtcgccggcgaggctcgacgccgacgaggacgacgacgaccaccccaagaacagcctcctgccccaagaactcgacgaagattatcccaaggaccagtcggattcttctcgctcgcgctccgacgcgagccatgggagagctggcaatggctacgacagcggcggcttcgagttctacagggaggagaggccgccgccaccgccgccggcggcggtggcggtggtcggcgggacgttcttcaggcaggtgccgtcaaagtggaacgacgccgagaagtggctcgccgggagacacgtcgtgcactccaacccaatcttctccaagaaggccgccgccgcagcagcggccgtgtccggccgcgttgcgccggaggcctcggcgtcgtcgtcgccgccgtcggtggcgagcaggcagcgccagcagaagaggctccgcgtgtcgtcggaggcggcggcggtgtcgatgcgggacgtggggacggagatgacgccgatggcgagcaaggagcagtcgcggagcggcacgcccgccggcgccgccacgccgtcgctgagtccgctctgctcggtgccgacgagcccgaggggcgccgcgtccgcgtcgtcggcgtcgtcggagcgggagctccagatcaggacgcgccgcgagatcgccgcgctcgggctgcagctgggcaagatgaacatcgcgtcgtgggccagcaaggacgacgacgacgagctcccccgcgcctcgccggagaagagaccgagaccgagaccgagacctcactccggcgacggcggcggcgaggccaagaagagggagttcgaggcgcgcgccatggcgtggcaggagacgcacaagtgcaagctcgcgttgaggtttcagaggaaggaggtgaagattcaggaatgggagagctgccagaaggccaaattcgaagccaagatgaggcacgcagaggtgcaggcagagcagatgaaggcgagggcgaagcagaagctgagcaggaggctgtcggcgttgagccacaaggcggaggggaagcaggcgagggtggaggctcgccggagccggcaggcggcgcggctggcccgccaggtgcaccgcatccgggagaccggcgccgcgccgtcgcgcctccgccgctgctgcagctggctgttcctctgaacatctgaagaaaaac

SEQ ID NO: 293 - protein, 427 aa, Oryza sativa
MEYERIHKVQMGVMSPTKLRMKLLGSHGGSIGRVDEAKKSPRASPARLDADEDDDDHPKNSLLPQELDEDYPKDQSDSSRSRSDASHGRAGNGYDSGGFEFYREERPPPPPPAAVAVVGGTFFRQVPSKWNDAEKWLAGRHVVHSNPIFSKKAAAAAAAVSGRVAPEASASSSPPSVASRQRQQKRLRVSSEAAAVSMRDVGTEMTPMASKEQSRSGTPAGAATPSLSPLCSVPTSPRGAASASSASSERELQIRTRREIAALGLQLGKMNIASWASKDDDDELPRASPEKRPRPRPRPHSGDGGGEAKKREFEARAMAWQETHKCKLALRFQRKEVKIQEWESCQKAKFEAKMRHAEVQAEQMKARAKQKLSRRLSALSHKAEGKQARVEARRSRQAARLARQVHRIRETGAAPSRLRRCCSWLFL

SEQ ID NO: 294 - DNA, 1739 bp, Oryza sativa
agttcattgaacttcacataagctcaccaagtaaccaaaacacataagctcagcttcagctcagtctcctccatggagcccaagtcttcttcttcctcacactatctgcagccatctgcaacattgccatcaacaagaagaaactcattccaaggagtgggagctgaagctggaggaggaggaggaggcatgaacccattcgggcccacattcagtgacccactctgcagcctcaacctcaaggagacctcagagttcgtgaggtcatccttccccatggctaccatggcgaggagcaacagcagcaacggcgccaccggcaatggcggccatggctaccaccgcgagacctccacggcctcttcatcctcttcctcctcggcctcagctcagaggaggcgagccgagcagcagcagcagcaggtgccagctactccagggcggccattgctgttcttcaattcctcgagccctgcacatcaccagctcgtctccgcgaggaggtcggtgccttccaagtgggaggatgcggagaagtgggtgaggcaggcgtcgtccgaccaccatggcggccatcaccaccaccatggcaagggctccaagcttcaggaggagaagagggcgtcggcggtgaggaggtcggtggatgctgacgtcactgctcttgctctctacactgctcctgctgcagaagtgttcctcaaagacaagttcactgacaatgtggagccctccaaggagagcttcgtgttccggagctcctactgcgagccaacaaagaacacggcggcgcaggcggtggccgccggcaacggcatcgaccaccggcgtgacatcggcacggagatgactccgctgggcagctccaccacctcgaggtgccacacgccgatcaagagcacctcgccggcgaggcacaacacgccggcgagccggtcgggccccctggtgccgtacgccggcggtggcggcggcgccggccaggacatctcggacctcgccgactgccacttcgccaagctggacctcggcgcgcagttcgacgccatgctcatcaactggagctccaaggaggaggaggaggaggaggtgtccaagagcttgaggcacttcgaggccagcgtcgccgccgtcggcgagaagcgcggcggcgccggcgactgccggtgggaggacgatgacagggccaagagctgcataaggtatcagagggaagaggcaaagattcaagcttggatcaacctggagagtgccaaggctgaagcacagtccagaaagctagaggtgaagattcagaagatgagatcaaacctggaggagaagctgatgaggaggatgacgaccgtgcaccggcgcgccgaggagtggagagcgacggcgcaggcgcagcacctccagcagctgaagcgcgccgccgagcaagtccggcgggccaaggccaccagccaccatcaccaccaccaccacctcgccggcagcaacgcctcctgcggctgcttcccctgcaatggcagcaacaacatcatcagtggcaacctcctgaactactattagatatgatcagctagccgccatggaagaaggatcaagaatgccaatttgttcgggagatcaacgggttcttgttgattgtagtggatgtttgggacgtgtgaagatggagatgtgggagataatggtgtcatgtgtatcaaaaaactctgatttttcaaggtgatatataccagattgctgaatgc

SEQ ID NO: 295 - protein, 493 aa, Oryza sativa
MEPKSSSSSHYLQPSATLPSTRRNSFQGVGAEAGGGGGGMNPFGPTFSDPLCSLNLKETSEFVRSSFPMATMARSNSSNGATGNGGHGYHRETSTASSSSSSSASAQRRRAEQQQQQVPATPGRPLLFFNSSSPAHHQLVSARRSVPSKWEDAEKWVRQASSDHHGGHHHHHGKGSKLQEEKRASAVRRSVDADVTALALYTAPAAEVFLKDKFTDNVEPSKESFVFRSSYCEPTKNTAAQAVAAGNGIDHRRDIGTEMTPLGSSTTSRCHTPIKSTSPARHNTPASRSGPLVPYAGGGGGAGQDISDLADCHFAKLDLGAQFDAMLINWSSKEEEEEEVSKSLRHFEASVAAVGEKRGGAGDCRWEDDDRAKSCIRYQREEAKIQAWINLESAKAEAQSRKLEVKIQKMRSNLEEKLMRRMTTVHRRAEEWRATAQAQHLQQLKRAAEQVRRAKATSHHHHHHHLAGSNASCGCFPCNGSNNIISGNLLNYY

SEQ ID NO: 296 - DNA, 1261 bp, Oryza sativa
ttaacttacaagttaatcttgaacgttgagtgccacaggcccaggaataagattgaaaggtccgatttcctggtacaggaacaggaagatcaaggtggtaaccagactataagaatgcaacctcaacaaggtagattttttggaagagaggaaatgagcaatggagtagaatacgatgctgcatatgcagccacagtggctgcggtagcgtatgctattgcagcaaaagaggaggagaaacaggcaacagaagagacccgtgtgaaaaagaagttaacatctgaaaagaagcctgtcgcgaacgatgagccttcgaccacaccaactctcaaactaccacccaacagacaaggaatcttgaaaaggcctaggcaaaccgaggggagcagaatcacaaggcggtttagtggtaaggagattgtacccgatgaagaagacgacggactagaagctaatgtatcggtgaggaggccggtgagaacggcacaaaagataccagaaggtggaatttcaggtcaaaatatggtagggaaggttcttgattctgtcccaagcataagaaaggctccgagcttcgccaagcctttaccagaaaagaaggggagcatgaaatttgagcaagagcaggcaatcccaacggtgccaccgaatgttaggccgacagctttatttccccgagagaagaaagagagcaagaaatttgatcaagaccaggcaatcccaagggtgccaccagatgttaggccaacagcttcattttcccgagagaagaaagagagcaagaagtttgagcaagacaaggcaaatcaaatgccatctttggcttccgcgccgacgagttcatattctagtgaggctgaagcaatggcagatacgtgggagaaggaaaagatggcaaaaatcaagaagcagtacaacatgacaatggataccatcgtcgaatgggaggccgagaagaaggccaaggccaaacgccagatggagttgaaagagggcgataattcagagcggaagcgagagaaggcgctggaggagtacaacgacgagattacaaggatcaacaaggtggccgcagcatcaaggctgacggcggaggagaagcggaggagcgcagagaggaaggtgagggagaaggcagagaggattcgggtgacgggaaagcttcccggcgcatgtggctgcttctgaaaaccatcaatgtgtcaatgtgtagtggatgtggctgtttcaaatgaaatttatgtgaaattgaaccaagcag

SEQ ID NO: 297 - protein, 357 aa, Oryza sativa
MQPQQGRFFGREEMSNGVEYDAAYAATVAAVAYAIAAKEEEKQATEETRVKKKLTSEKKPVANDEPSTTPTLKLPPNRQGILKRPRQTEGSRITRRFSGKEIVPDEEDDGLEANVSVRRPVRTAQKIPEGGISGQNMVGKVLDSVPSIRKAPSFAKPLPEKKGSMKFEQEQAIPTVPPNVRPTALFPREKKESKKFDQDQAIPRVPPDVRPTASFSREKKESKKFEQDKANQMPSLASAPTSSYSSEAEAMADTWEKEKMAKIKKQYNMTMDTIVEWEAEKKAKAKRQMELKEGDNSERKREKALEEYNDEITRINKVAAASRLTAEEKRRSAERKVREKAERIRVTGKLPGACGCF

SEQ ID NO: 298 - DNA, 2845 bp, Oryza sativa
ggctcgcgtcagacagactccctcctctcctcgagatgctgtacttgccatcggtccatcacccttccatcccgccacgttgcgatcccctcggccacttctattaaacgccaacgtactcctcatcacgcctccaaacccgccgctttgattgtacttgtgctttgctgttaaagagctcgccggcgtgagtggtggcgggtagaagttatatggagagaatgcggtgtgttggtggtggtgacaccccgttggggtttcggggcgtcgtggaggaggagctagaggaggaggtggcggcggtgtcagcgtcggggaggccaatgcagcggcagcggcggcggcggcggcggtggggagaggatgccgacgatggctactcggcgagctcgactggcggcggcgggagcagcggatgcggctccttcggctgtgactcgcctttggctgggttcgtgcgtgctgatggcgacccggacacagatctggagacagatggggtggccactccatcctccaatgcctctgcagcattcgccgagccacacgacgaggaggagggggacgaggtgttgtgtggggtggtggaaggggactgggcacagctgcaagaaccaaccaagagtccggcagaccgtaccaccggagaatgcctgtaccagcggcgccggtcagaagctgttcttttgcagggtaggaaggggttgaagcaacggccagcctctctggactttggcagcggcagccccgggttcaatggagcccctctttctccgggctttgtggttgggggtgtgggtttgatgaacaagggtcttgtgtcatcatcattcatcagatcagacgtttttcctagtcccaggacaccgaactatcggcggcatcgttcatcagtatttggttaccaaaaggggtggagctctgagagagtaccgcttgcttccaaaggtaacaggaggtacccaggcagcagcatggcatttcccttcagcaatgggaggacattgccctccaaatgggaggatgcagagagatggatcttcagtccgaattcgagtgacgtgctcgagaagacttcatttgctcctgctcggcgaccaaagtccaaaagtggtccattagggcctcctggaaaatttggtggacaatactcatctgtgtcattgcttgacaatgggagagttggacatttgacagcaaactcgcctttcttggctggagtactgataccagaacattattgtggagagaaagataacattgggaggtatatgagcagaacagctggtgaggaggccagcattggcattggaggcaagtcttgtctggcaaatggtgggtctcatgctactcaatataacagagttcgtcgacgactggatactgcgattgagtcatcaccttcattgcctagcacccaagcgtctgtacaagatgaacaggttggaatcacagaagagtcagcctccattatcacccctataattttgcggaaggatgcggcaactcaaacaagcccaaatctaagtcggtcatcttcgcccagtgtcagtactccatttatccatttgcttacgacacaccaagtcagagaaaaggagaattgtttctctgatgttatcagggatgtgcacatggacgatcgagtgactcttaccaggtggtccaagaaacatgttacacgagcatctagcaagaactcaacaaatgttatagatgtgaagaaaaagacagtggagtctaagtcttcttcctgggaattaacagaagcaaaatccatatcaaaggttgagcgagagcaagaaaaaattactgcttgggaacacctccaaaaagccaaggctgaggcagcaatccaaaagttagtgatgaaaatcgagaaaaagagatcatcttcactggacaagatttggaacaccctcaggtctgcacaaagaagagcacaggtaatgcgtgaaactgcagcagcaaaccaggatgagcaatcttccgggaaggctaaaaggacatcacaccttaataagaacggccagatcagctctctgagtggctgcttcacttgccatgccttctagtgtcatgtagtttaagaaggaacaggacttaaagtaattcttcgtgttatcaacacgctcgtgttgacttagtgaagttcagagatttacagaataaagatgatccagcagatggaaattatccccccttgaattttgacaagatgctgctgcaacaatgggggaccatgcattatcatgatatagatttctacagttctgctttgtgttagtttcgattctgccatggggggacaagagaaaatggtgccacgaaggaaaggtgaaattcttctgcatacatcccatgtgcctgattgatatcttagcacaatgataattgataaggtcctcctctatcattcattacccattaccaacattctagatgctatgagtttgtgtgcgatgaaaacaaagcagatatgtatcatttgcaccacaattccaacggatagataagaagggaatgtttcagtcagagggaatacagtgccttactgtgattcatgctggaaaactctactggattgtgaaagggaaccaggtggaatgcaatagatttagctagcgtatgctacatttgcatacacagttacaatagcatgtgttggagaaaaatataggaatacaggaaaatagagattctgtttgaatttcatggcaatttgacaagctcttcgcagaacaactctcccatttctgtaatgagctgtttcttgtaattcctattgcaacacataggcgttactgaatgttgataaatgatattgccatcgcaattttttttt

SEQ ID NO: 299 - protein, 620 aa, Oryza sativa
MERMRCVGGGDTPLGFRGVVEEELEEEVAAVSASGRPMQRQRRRRRRWGEDADDGYSASSTGGGGSSGCGSFGCDSPLAGFVRADGDPDTDLETDGVATPSSNASAAFAEPHDEEEGDEVLCGVVEGDWAQLQEPTKSPADRTTGECLYQRRRSEAVLLQGRKGLKQRPASLDFGSGSPGFNGAPLSPGFVVGGVGLMNKGLVSSSFIRSDVFPSPRTPNYRRHRSSVFGYQKGWSSERVPLASKGNRRYPGSSMAFPFSNGRTLPSKWEDAERWIFSPNSSDVLEKTSFAPARRPKSKSGPLGPPGKFGGQYSSVSLLDNGRVGHLTANSPFLAGVLIPEHYCGEKDNIGRYMSRTAGEEASIGIGGKSCLANGGSHATQYNRVRRRLDTAIESSPSLPSTQASVQDEQVGITEESASIITPIILRKDAATQTSPNLSRSSSPSVSTPFIHLLTTHQVREKENCFSDVIRDVHMDDRVTLTRWSKKHVTRASSKNSTNVIDVKKKTVESKSSSWELTEAKSISKVEREQEKITAWEHLQKAKAEAAIQKLVMKIEKKRSSSLDKIWNTLRSAQRRAQVMRETAAANQDEQSSGKAKRTSHLNKNGQISSLSGCFTCHAF

SEQ ID NO: 300 - DNA, 2200 bp, Oryza sativa
aaagctagtcgctgactgacgctgcccgccgtgtggccgtgcattgctgtccctgagcttgctgctgctggtggtggtgacgattctgctcggtagaggagatgcgagttgggggtgagctccacagcggcggcggaggaggagagggggtgttggtggggaggggatggaggaaggaggaggcggagggaggcggcggcggcggcggcggcggcggcgggtgctcggcgagctcgacgagccggggatcgtctctctgcgactcgcctttgcccagctttgtgcgccatcgtggtggaccggggtcagatctagagctcgatgggttgcccacttcctcctccaatgcttcctcagggtcacacgaggaggatcacgggccattgcaaggggtgaagggagaggggtggatgcaagtgcagggaccgatcaagaactcagctgcccgttctaccggagaatgccaagaccagcggtaccggttggggtctgttcttttccatggtaagaatgaacggaagcagcgcccggcttcagttgattttggctgccccagtgttgacagatcctccacgcattctccgggtttcttggtcaatggtaccggggcgatgaacaagggattgagtgtatcatcgcaaaataaaccaggtgcgccgactagcccaggaacaccaagctacaatcgtcagggtgcaacagttgttgggtatcagcagggttggagctctgaaagagttgccctgtcttcaaacggccagagaaggcattcaggcaacagcatggtgttaccacataatactgggagaacattgccctcaaaatgggaggacgcagagaggtggatcttcagtccgaatcccagcaatgcacttggaaggacctcaatcccgcagtcgcggcgacctaaggccaaaagtggacctcttggacctcctggcagatttagtgaaccatactcatcagtttcgtcatcgtcatatttgcttgacaccgggagagtaggaaacctcacggcaaactcacctttcctggctggggtcttgctgcctgagcatgtttgtgtgtccagtagccatgctggaagggatctaagtggtgcatctggtgaggataaaagcaatggcatgggaggcaggtctggtgaagcaaatggtgcacatcctgccgtgtggtctaccagagtttgccaacgaatggatagcgcagttcagtcgtctccgtcattgcctacttcccaagaatcagttcaagcttgcacagatgaacagatcgaaatcacaacagacttgaccaccagcagtaaacctgaaatttcgagaaaagatgtggcaacacagactagccctgagcttagcaggtcatcttctcctagcgggaggccttcattttcccgctcactatcagtacagcaagtcaaagagttggagagctgtttctctaagcttgagataagggatgtgcagatggatgatcgggttactctgaccaggtggtccaagaaacatgtcacacgaggctctgagaagaactcgacaaacattatagagtggaagaaaaagacagtggaatctaaatcttctgcctgggaagtaacagaaactgcaaagtgtatatcaaagattgagggagaggaagcaaagatgactgcatgggagaatctgcaaaaggcaaaagcagaggcagcaatacaaaagcttgtgatgaaacttgaaaagaaaagatcatactcactggagaggattttcaataccctcaggtcagctcataggaaaacacatgtgatacgcagcacaactaccacaaatcttgatcagcacatctccaggactgtgaaaaggccatcacaccttagcaagaatggccaaatgagttcgctgagtgggtgcttcacttgccatgccttctagtatggtattatacagtcaagcggcactgtcactttcaagatggaattggaggggggaaccaaaaggcttgctagtatagaatacagataagacctagcaggggaagccgaggctctcaatgatatccaatggtctgtcattacaagatttattctagaatttccctttttattctgctcaggaacaaaaggaagttgacgcagagggaaggagttgttactacacaccttgtgaagtatttgtaataataaaaatctctgcctatactcttcagggcggagtggtatcat

SEQ ID NO: 301 - protein, 602 aa, Oryza sativa
MRVGGELHSGGGGGEGVLVGRGWRKEEAEGGGGGGGGGGGCSASSTSRGSSLCDSPLPSFVRHRGGPGSDLELDGLPTSSSNASSGSHEEDHGPLQGVKGEGWMQVQGPIKNSAARSTGECQDQRYRLGSVLFHGKNERKQRPASVDFGCPSVDRSSTHSPGFLVNGTGAMNKGLSVSSQNKPGAPTSPGTPSYNRQGATVVGYQQGWSSERVALSSNGQRRHSGNSMVLPHNTGRTLPSKWEDAERWIFSPNPSNALGRTSIPQSRRPKAKSGPLGPPGRFSEPYSSVSSSSYLLDTGRVGNLTANSPFLAGVLLPEHVCVSSSHAGRDLSGASGEDKSNGMGGRSGEANGAHPAVWSTRVCQRMDSAVQSSPSLPTSQESVQACTDEQIEITTDLTTSSKPEISRKDVATQTSPELSRSSSPSGRPSFSRSLSVQQVKELESCFSKLEIRDVQMDDRVTLTRWSKKHVTRGSEKNSTNIIEWKKKTVESKSSAWEVTETAKCISKIEGEEAKMTAWENLQKAKAEAAIQKLVMKLEKKRSYSLERIFNTLRSAHRKTHVIRSTTTTNLDQHISRTVKRPSHLSKNGQMSSLSGCFTCHAF

SEQ ID NO: 302 - DNA, 1953 bp, Oryza sativa
aggtgaggaggaagaggaggaggaggagtggagaggcgacggcgacgcgggctcggaggaggaggagggggaagcggtcagtgactccttctcccactcgctgagagagtgccagaagcagcggaagctcagagcggagggggctgcgttgctgctttcaccggccaagcatgagctcaccggcggaggtggtgggagcatagaactgctggtgctctcgccgaggtgcttggttgggggtaatgttggaggaatgagcaagagctccacagcgtcatcacggagcagatcaggcacattcccgagccccggtaccccaaactaccaccggcattgcgctagcaccatgcagtaccctaagggatggagctcagagcgggtgccacttggaggtggtaccaataggaggtatgggggcagtggggttgttcttcctttcaacaatgggaggaagctgccatcaaaatgggaggatgcagagaagtggatcctaagtccagtttcctgtgatgggattggaaggatgtcagccccggcgcctcaccatagacggcccaagtcaaagagtggcccacttggccacccaggcggaataccgggtgcttatgcggctgcttcgccgtttgtgccctgctttgatggtgttctggcagcggctaattttgcagcacattctcctttttctgctggggttctcatgccagagcacgtgcgcaatggtgacttcagcagtggaagaggtagaagtggggatgatggcagtagccgatcttactctgcagagaaggacccatatatcttgagatcagcaagtatacatgcgtggacagagacacttatggaagcatccgcctttgctaatatctcagaagaaactgcacaagatgataaattgcaaggcctgcgaggagaaactcctgccatttccagtccaataataaagaaagatgttgccacacaaatgagtcctgatgacagtatatcgtcttctccaaaagcaagacattcatgttccagtttaccatcaggacatcctattaaagaaccaaatagtaatgcacttaaacctgaagtccgagatgtccaggtagatgatcaagtaactgtgacccggtggtccaagcgacatgtaacacgagggtctgataggcggtcaacaaatattgtcgagtggaggaagaaaacaattgagactcgagctccatcttttgatgaaaaagaaagagaaagctgcgtatcaaagtgcaagagggaggaagcgaagatcactgcttgggaaaatctgcagaaagcaaaagcagaggcagcaattcgaaagttagagatgaagcttgaaaagaagaggtcatcatcgatggatagaatcttgggcaaactacgcactgctcaaaagaaagcgcaagacatgcgtagtgcagtttctgtgagtgaagatcaatgtggagtgagagcaaccaagaaagcatcatacttgaggagaacgggcaaatcattcagttgctgtttcacctatcgtgcttgctagttgtgacatagttggtaccgtgggcgtagcaatggatgtacctttgtagaaactttttggacgttgcagctcatgtcagccaacaaatcagaattaatcaggaagtcagatttttccttgctgtggcagctggaggtgacggggttatttaaagagaatttgcatggtctgatcgatgaaatacctgtagtgccagtggagtggtataaatcagtcatcgagcaaaatctatattgtagttaatttcgtggattattgctcccgttattctgtgcctacaatcaatctctgtacacccaatagaagctccttcgagttcgagagctttatgctagtcaccaccagattggccaggttcagtggttctcattctgattgatatgtatctttccatgggattctgtaagcaaagcaagccttggggcttg

SEQ ID NO: 303 - protein, 423 aa, Oryza sativa
MSKSSTASSRSRSGTFPSPGTPNYHRHCASTMQYPKGWSSERVPLGGGTNRRYGGSGVVLPFNNGRKLPSKWEDAEKWILSPVSCDGIGRMSAPAPHHRRPKSKSGPLGHPGGIPGAYAAASPFVPCFDGVLAAANFAAHSPFSAGVLMPEHVRNGDFSSGRGRSGDDGSSRSYSAEKDPYILRSASIHAWTETLMEASAFANISEETAQDDKLQGLRGETPAISSPIIKKDVATQMSPDDSISSSPKARHSCSSLPSGHPIKEPNSNALKPEVRDVQVDDQVTVTRWSKRHVTRGSDRRSTNIVEWRKKTIETRAPSFDEKERESCVSKCKREEAKITAWENLQKAKAEAAIRKLEMKLEKKRSSSMDRILGKLRTAQKKAQDMRSAVSVSEDQCGVRATKKASYLRRTGKSFSCCFTYRAC

SEQ ID NO: 304 - DNA, 1824 bp, Zea mays
atggccaccaccctcgccaggagcatcagcaacagcaacgggcacgaacgccgccacgaggcctccaccacctcgtcttcgtcgtcctcctccacggcctcggctcagaaacgaaggggggagtcgcagcagcaggccgccgtcgtcccggcgacgccggggccgggtccggcgctgcagttcctcgcgagccccgccgcgcaccaccaccacccccagacccagctcgtcgccccgaggaggtcggtgccgtccaagtgggaggacgcggagaagtggctgcggcagtcgtcgtcgtcctcgggttccgaccaccacctccacggcaacgcgagggccgccttctccaggcagcggagcggcgggctcggacaccgaggcggcgccggaggcgggggtggggacgagaagagcgcggcggtggcggtgaggaggtcggtggacgcgctccgggacgcccactcgctcgcgctgtacgcggcgccggcagcggaggtgctcctcaaagacaagttcaccgacaatgaggagccgtccaaggagagcttcgtgttccggagctcgtgctgcgaggctgctgaaccggcgaagggcgccgacgacgacgacgacggtcgctgccagcggaggagggacgtcggcacggagatgacgccgctgggcagctcgtgccacacgccgctcaagagcgcgtccccggcgcggcacaacacgccggcgagccggtcgtcgggcccgctggtgccgtacaccggcggcggcggaacggacatctcggagctggcgggattccgcctcgccaagctggacctgggcgcgcggttcggcgcccacgccacgctcgtcggctggagctccaaggaggaggaggaggacgacgacgaggacgtgtccaagagcctcaggcacttcgaggccaccgtcggcgggacagcctgcgatagacgcggcggcggcggcgactgccgttgggatgacgacgacagggccaagagctgcatcaggtatcagagggaagaggcgaagatccaggcctgggttaacctggagagcgccaaggctgaagcgcagtcaagaaagctggaggtgaagatccagaagatgcggtgcaacctagaggagaagctgatgcggcggatgacgacggtgcagcggcgcgcgggggagtggcgcgccacggcgcgggcgcagcacctccagcagctgcggcgcgcggccgcccacggcgacggcgacggacggcggctcagggccacggccacgtccacggcccaccaccaccaccgccacctgccgggcagcagcgacgcgccctcctgcgcctgcttcccctgcagcaccagcaccagcggcggcggcggcgttttttacttgaagcgcgtcgcgacagagcacggccatctatgccgcgcaggcggggggcccctgtcgtggagccgtgtgtccatgtcggggagcgagaagggggcggctgaaccaacgcgaggtgatggccaaccacgccgtggatgttactgcagcctgctgctactttcctccactgccgtgccgcagcagcagcaggcagaggttggattggattggacggagaaagaagaagtaccatcatgtcttgccttgaccacgttccccgagtcccacgtcgacggcggaggtcgaggtcgtcgtcggccgtcggggtcggggcacgacctcaccaggcctcctgctcctccatggactggggccaccaacggtgatgggagtattacgtgggcccgccccgcctccgagcgcaccggccgtcttggcacggccatccaggacggcaaggccctgtactag

SEQ ID NO: 305 - protein, 607 aa, Zea mays
MATTLARSISNSNGHERRHEASTTSSSSSSSTASAQKRRGESQQQAAVVPATPGPGPALQFLASPAAHHHHPQTQLVAPRRSVPSKWEDAEKWLRQSSSSSGSDHHLHGNARAAFSRQRSGGLGHRGGAGGGGGDEKSAAVAVRRSVDALRDAHSLALYAAPAAEVLLKDKFTDNEEPSKESFVFRSSCCEAAEPAKGADDDDDGRCQRRRDVGTEMTPLGSSCHTPLKSASPARHNTPASRSSGPLVPYTGGGGTDISELAGFRLAKLDLGARFGAHATLVGWSSKEEEEDDDEDVSKSLRHFEATVGGTACDRRGGGGDCRWDDDDRAKSCIRYQREEAKIQAWVNLESAKAEAQSRKLEVKIQKMRCNLEEKLMRRMTTVQRRAGEWRATARAQHLQQLRRAAAHGDGDGRRLRATATSTAHHHHRHLPGSSDAPSCACFPCSTSTSGGGGVFYLKRVATEHGHLCRAGGGPLSWSRVSMSGSEKGAAEPTRGDGQPRRGCYCSLLLLSSTAVPQQQQAEVGLDWTEKEEVPSCLALTTFPESHVDGGGRGRRRPSGSGHDLTRPPAPPWTGATNGDGSITWARPASERTGRLGTAIQDGKALY

SEQ ID NO: 306 - DNA, 946 bp, Solanum tuberosum
ttaccttcctccaactactaaatatcttcttctttgaagaattctctgttttcttgattctgtttgtagccatggcagaattggaagctaagaaagtagaaattgtggaccctgcaccccctgcgccaggacctgttgaagctcctaaagaagtggtggctgatgagaaagccatagttgcaccagctctgcctcctcctgcagaagaaaaagaaaaacccgatgactcgaaagcattagttgtcgttgaaactaaagcaccagaacctgctgatgagaaaaaagagggatctattgacagagatgctgtgcttgctcgcgttgcaacagagaagagagtatcactcatcaaagcatgggaggaaagtgagaaatcaaaagccgaaaacaaagctcagaagaaggtatctgcaattggtgcatgggagaacagcaagaaagctaacctagaggctgagctcaaaaagatggaggaacagttggagaaaaagaaggccgaatatactgagaaaatgaaaaacaaaattgctctactccacaaggaagcagaagaaaagagagcgatgattgaagctaaacgtggagaagatcttctcaaggcagaggagcttgcagcaaaataccgtgccactggaactgctccaaagaaaatccttggaatattttgaagcagcaagcaccaggtctgcatcggtagtgattgggagttacattttgtaaagtttgtgcaattggaattttgtttcttgttagattacatttgtgtgattatgtattttagaaccatttattgtttattgttacgtgtgcatagtgatgtatttccagtgtatatagcacctggacaaattaactttgtgggattgtatgaaaaaaaatgttgaaggaaatcttcatgttagtacacaactcttgcagaaaaaaaaaaaaaaaaaaaaaaaaaaaa

SEQ ID NO: 307 - protein, 198 aa, Solanum tuberosum
MAELEAKKVEIVDPAPPAPGPVEAPKEVVADEKAIVAPALPPPAEEKEKPDDSKALVVVETKAPEPADEKKEGSIDRDAVLARVATEKRVSLIKAWEESEKSKAENKAQKKVSAIGAWENSKKANLEAELKKMEEQLEKKKAEYTEKMKNKIALLHKEAEEKRAMIEAKRGEDLLKAEELAAKYRATGTAPKKILGIF

SEQ ID NO: 308 - DNA, 1581 bp, Glycine max
atggcggaggtagggtttcaggaacgaagctcgtggagagtggggctgagagcgcgctatagcagccccgactctgtggttttcactctcgaatcgaacttgagcctcttctcctatgcgtccgcgagcgttgatcgatgctccttttcatctgattcacacgaccacgactctttcgtctccgaaatctcactggatatgcggtggtggtggcataataataataataatggaaaagattacaaacacgccacgagggcttttaatttcggaaaaattgacgctgatattcaagaacccgtggagttggattctgccagaaactctttctctttagccctcaaagaggctgcttctttggatctgaacaatgcctctggctctggatctttgccgcgccttcaaacattgaaaaagacttccatttcttctcgaaggtctggtactgccactttccctagtcctggtacactcaattatcgcgttgcaatgcacaagggatggagctccgagcgagttcccttgcatgcaggtgctacccggaagcacgttttgccgttcaacaatgggaaaacattgccgtcaaagtgggaagatgctgagaggtggattctcagccctgtttcggcagatggcactgggagggcctcgcttaatgcaccccaaaggaggccaaagtccaagagcggtcctcttggaccccctggtgttgcgtatcattctatgtactcgccggccgcgccggtgtttgaagtggggaatggggggagttttatggaaggttctccgtttacaggtgatgggttaataatctgcaccggtggccatggtggagctctttccgtgagaacagaaccttgcatggcacgctcagcaagtgtccacggatgctctaagatacagagtcagtcatcatcaatgcccctccaagaggataagtttggtgggttcaaagatgtgggcaccaatgtgtcccgtgccacttcaaggagggacatggcgacccagatgagcccacagggtagctcacgctcctctcctaatctgaggccttctttctctgcctccaccccatcaaccttgcctgtcacagaattgcggactgttggttcctctaaagtggatattagggatgtgcaggtagatgaacacgttaccgtgacaagatggtccaagaaacatagggccctattcactggcagaggctcagaaaaagtcgaaagctggaaaaaagaactaagcactcaatcgtcaacttgggacgtttctgaaacgtcaaagcctgcctcaaagacaagaagtgaggaagccaaaatctctgcatgggagaacttgcaaaaggcaaaagcagaagcagcaatacggaaactagagatgaaattggaaaaaaggcgagcatcctctatggataagattatgaacaagcttagattggcccagaaaaaagctcaggaaatgagaagttcagttccacacaaccaaaccgatcgggttgtaagaacttcacacaaggcttcatcatttcttagaaccagccagatgcgttctttgagtggttgtttcacttgccatgtcttttaa

SEQ ID NO: 309 - protein, 526 aa, Glycine max
MAEVGFQERSSWRVGLRARYSSPDSVVFTLESNLSLFSYASASVDRCSFSSDSHDHDSFVSEISLDMRWWWHNNNNNGKDYKHATRAFNFGKIDADIQEPVELDSARNSFSLALKEAASLDLNNASGSGSLPRLQTLKKTSISSRRSGTATFPSPGTLNYRVAMHKGWSSERVPLHAGATRKHVLPFNNGKTLPSKWEDAERWILSPVSADGTGRASLNAPQRRPKSKSGPLGPPGVAYHSMYSPAAPVFEVGNGGSFMEGSPFTGDGLIICTGGHGGALSVRTEPCMARSASVHGCSKIQSQSSSMPLQEDKFGGFKDVGTNVSRATSRRDMATQMSPQGSSRSSPNLRPSFSASTPSTLPVTELRTVGSSKVDIRDVQVDEHVTVTRWSKKHRALFTGRGSEKVESWKKELSTQSSTWDVSETSKPASKTRSEEAKISAWENLQKAKAEAAIRKLEMKLEKRRASSMDKIMNKLRLAQKKAQEMRSSVPHNQTDRVVRTSHKASSFLRTSQMRSLSGCFTCHVF

SEQ ID NO: 310 - DNA, 840 bp, Medicago truncatula
atgttgaataataatctaaatacttccaccagccatatatcagaggaaaaccaagaagatgaacaaataacagaaataagagaaatccatgccttaacaccacctcgtcttccacctcctccaccaccaaccaaccgcggcagccatagccaccgttcatcatctctatccatggctagcacagatagtgaaaacttcacaactataagcagagaattcaatgctctagttctagcaggatcaactgttgaccacaacaacataagtcctcatgaacatgaaacagctaacaacaacaataacaataacagcaacaatttgaggaggattagagaagatgatcatatgatggaagaaaccaatcctttggcgattgtggtagataacagcccttttgatcctattccatctcctactagcagaagaaatatggctagtggaagttcacgtgcaagtggtcaaggtggtagtgaagaacatgtgtcggtggatagggtgaagaaggaggaagttgatgcaaagatatcagcttggcagaatgctaaagttgctaagattaataacaggttcaagagagatgatgctgtcatcaatggctgggagagtgaacaggttcagaaagctacttcatggatgaaaaaagttgagaggaagctggaagagaaaagagcaagagccttggagaagacgcaaaacaaaatagcgaaagctcgaagaaaagccgaagagaggaaagcatcagcagaggcaaaaagaggaactaaagtggctagagttcttgagattgctaatcttatgagagcagttggaagacctcctgctaaaaaatctttcttctaa

SEQ ID NO: 311 - protein, 279 aa, Medicago truncatula
MLNNNLNTSTSHISEENQEDEQITEIREIHALTPPRLPPPPPPTNRGSHSHRSSSLSMASTDSENFTTISREFNALVLAGSTVDHNNISPHEHETANNNNNNNSNNLRRIREDDHMMEETNPLAIVVDNSPFDPIPSPTSRRNMASGSSRASGQGGSEEHVSVDRVKKEEVDAKISAWQNAKVAKINNRFKRDDAVINGWESEQVQKATSWMKKVERKLEEKRARALEKTQNKIAKARRKAEERKASAEAKRGTKVARVLEIANLMRAVGRPPAKKSFF

SEQ ID NO: 312 - DNA, 1863 bp, Medicago truncatula
atgcgtgatttagggtttcacgaacaacgacgctcgtggaggcgtaacaccggttcaagaacacgcaacaccaccgccaacaccgtcaccggcggcggcgatacaagtcctgactccgtcatcttcactctcgaatctaacttaagtctcttctcctccgcttccgccagcgtcgatcgctgctccttcgcttccgatgctcacgaccgcgactccttaaactccgaaatctcactgcatttggcaggtcacggtggtgattttgctcccagtgaaagctggagtggtccagatccggatccggatccgaatcaaaatcataacagaaaacaacatgcagattcagattcagttcagaaaaagaaacttggcgaaactcttttctctggaaaagcagaaaaaacaaaagttcaaaaggaagatagtgacattgattctaaagacggaaatcaactttcggaatttgattctgcgagaaactctttctctctagctctcaaagaatgtcaagatcggagatcgagatgtgaatctttatttaaaaagcaagatcggcgaagacctgcttcgttagatctgaacaatgctaatgcaactggaactggttcttcgcctcgattagttggagctgtgaagaagagtatggttcagtctaggaaatcgggaacgggtacagcgacggggactggtacatttccgagtcctgggactccgaattatcgtcattgtcaaggcggtgttgcaatgcaaaaaggttggagttctgagagagttgcaagtgggggccgcaagcaagttggtaatggtgtgactgctttgtgtttaagtaatgggagaacgttgccgtcgaagtgggaagatgctgagaggtggattttgagtcctgtttcagggggtgatggaactggaagggtttcagttccacagccattaaggaggccgaagtcgaagagtggtccgcttggtccacctggtgttgcgtattattcgttgtattcgcctgcaggtcacttttttgatggagggaattttatgacggctgcttcacctttttctgctgctgttaatgcttcagctgatgggtttacaaatagttctggtggcaatggtggtggagggcttcccacacgaacggatccttgcatggctcgctcagttagtgtacatggatgctctcagatgcagggtcaatcgtcgattccttcccgagaggagaagtttgatgctttcaaggatgcgggcaccaatgtatctcctgctgtttcaagaagggacatggcaacccagatgagcccagagggtagctcgtgctcctctcccaatatgatgacttctttctctgcttccattccacctaccctgcccgtaaccgatttgcagagtatctctttctctaaaatggatatcagggatgtgcaggtggatgaacgtgtaaccatgacaaggtggtccaagaagcacaaggccctattcactggtagaggttcagaaaatgttgacagctggaaaaagaaagaaaccagcactcgatcttcatcttgggaaatttctgaacgctcaaagactgtttcgaaggctaaaagggaggaagccaaaatcaccgcatgggaaaatttgcaaaaggcaaaagctgaagcagcaatacagaaactagagatgaagttggaaaagaagcgagcatcttccatggataagattatgaacaaactgaaattcgctcagaaaaaggctcaggaaatgaggagttcagtttcagtcgaccaggctcatcaagttgccagaacttctcacaaggttatgtcatttcggagagctggccagatgggttctttgagtggttgtttcacctgtcatgccttttaa

SEQ ID NO: 313 - protein, 620 aa, Medicago truncatula
MRDLGFHEQRRSWRRNTGSRTRNTTANTVTGGGDTSPDSVIFTLESNLSLFSSASASVDRCSFASDAHDRDSLNSEISLHLAGHGGDFAPSESWSGPDPDPDPNQNHNRKQHADSDSVQKKKLGETLFSGKAEKTKVQKEDSDIDSKDGNQLSEFDSARNSFSLALKECQDRRSRCESLFKKQDRRRPASLDLNNANATGTGSSPRLVGAVKKSMVQSRKSGTGTATGTGTFPSPGTPNYRHCQGGVAMQKGWSSERVASGGRKQVGNGVTALCLSNGRTLPSKWEDAERWILSPVSGGDGTGRVSVPQPLRRPKSKSGPLGPPGVAYYSLYSPAGHFFDGGNFMTAASPFSAAVNASADGFTNSSGGNGGGGLPTRTDPCMARSVSVHGCSQMQGQSSIPSREEKFDAFKDAGTNVSPAVSRRDMATQMSPEGSSCSSPNMMTSFSASIPPTLPVTDLQSISFSKMDIRDVQVDERVTMTRWSKKHKALFTGRGSENVDSWKKKETSTRSSSWEISERSKTVSKAKREEAKITAWENLQKAKAEAAIQKLEMKLEKKRASSMDKIMNKLKFAQKKAQEMRSSVSVDQAHQVARTSHKVMSFRRAGQMGSLSGCFTCHAF

SEQ ID NO: 314 - DNA, 1392 bp, Medicago truncatula
atgaacatgtatagcaaaaacaaggactattacaacaacaaaaacaacccttttgttgatgatttcattgatccactttgcaagctgaacctaaaagaaacctctgagtttgtcaaatctttaccagtttcaaacaccaatgcagaaaacagaagactcagcaatgattctgtaacacaaatgagaaaactagaagctccttctacacctggtagaccacttttcagcttcagttcttcttcttcttcaagcattgttggtagaaaccttccaagaaagagttttccttctaaatgggatgatgctgaaaaatggcttataagcacttcttgtcatgactcaccagctcataataacaacactttgaaaggtgtttcatctttagaatctggaacaagacattgtgataatggttttaagcagaaaatggaagaagggttttcagagaaatcaagggtcatagaagaaaaagtgttgtcaaaaagtgttactaattttcaaagttcttcttcaagtttggaccacaataacagtgttggagctttcaatggtatctcatgtccaccaacagacatagtactaaaagataagtacacagacagcatagagccaattttaccaaaattccggtattcagaaccaacaaaagaaggattcttattcagaaatcaagcttgtgaggcaatgcatgaatcttacacagaagtgattcatgaagttaaacacaaagatgttggcacagaaatgactccattaggaagttccacaacttcaagatgtcacacaccattcaagagttcatcgcctgcgcgccataacactcctgctagtaggtcaggaccattggcattatctaacattgacagcaatggatgcagtgttgatgctattcagctagaagagtgtcatttttctaaactgcaatttggaacgacaaagtatgatttggttgcaccaaattggagctcaagtgaagaggaggaaaaggaaatatcgaaaagtttgagacataatgctagtttgaaagccgattctgattgtatagctgccagttgggaagaagatgagaagaacaagtgctgtcttaggtatcagagagaagaagcaaaaatccaagcatggataaacctccaaaatgctaaagcagaagccaggtcaaaaaagcttgaggtgaaaatccaaaagatgagatcaaacctagaagagaagttaatgaagaggatgtcagtggttcacaggaaagctgaggattggagagaaacagctagacaacaacacttagagcaaatggagaaatcaactcaacatgctaaaaagattattcataggcataactcacaattttctaggcacagttcatgtggatgctttccttgcaataacaaccattaa

SEQ ID NO: 315 - protein, 463 aa, Medicago truncatula
MNMYSKNKDYYNNKNNPFVDDFIDPLCKLNLKETSEFVKSLPVSNTNAENRRLSNDSVTQMRKLEAPSTPGRPLFSFSSSSSSSIVGRNLPRKSFPSKWDDAEKWLISTSCHDSPAHNNNTLKGVSSLESGTRHCDNGFKQKMEEGFSEKSRVIEEKVLSKSVTNFQSSSSSLDHNNSVGAFNGISCPPTDIVLKDKYTDSIEPILPKFRYSEPTKEGFLFRNQACEAMHESYTEVIHEVKHKDVGTEMTPLGSSTTSRCHTPFKSSSPARHNTPASRSGPLALSNIDSNGCSVDAIQLEECHFSKLQFGTTKYDLVAPNWSSSEEEEKEISKSLRHNASLKADSDCIAASWEEDEKNKCCLRYQREEAKIQAWINLQNAKAEARSKKLEVKIQKMRSNLEEKLMKRMSVVHRKAEDWRETARQQHLEQMEKSTQHAKKIIHRHNSQFSRHSSCGCFPCNNNH

SEQ ID NO: 316 - DNA, 594 bp, Lycopersicon esculentum
atggcagaattggaagctaagaaagtagaaattgtggaccctgcccctgcacaagaaccagttgaagctcctaaagaagtggtggctgatgagaaagccatagttgaaccagctccgcctcctcctgcagaagaaaaagaaaaacccgatgactcgaaagcactagttgttgtcgaaaataaagcagaagaagctgctgatgagaaaaaagagggatctattgatagagatgctgtgcttgcacgcgttgcaactgagaagaggctatcactcatcaaagcatgggaagaaagtgagaaatcaaaagccgaaaacaaagctcagaagaaggtgtctgcaattggtgcatgggagaacagcaagaaagcaaacctagagtctgagctcaaaaagatggaggaacagttggagaaaaagaaggcaatatatactgagaaaatgaaaaacaaaattgctctactccacaaggaagcagaagaaaagagagcgatgattgaagctaaacgtggagaagatcttctcaaggcagaggagcttgcagcaaaataccgcgccactggaactgctccaaagaaaatccttggaatattttga

SEQ ID NO: 317 - protein, 197 aa, Lycopersicon esculentum
MAELEAKKVEIVDPAPAQEPVEAPKEVVADEKAIVEPAPPPPAEEKEKPDDSKALVVVENKAEEAADEKKEGSIDRDAVLARVATEKRLSLIKAWEESEKSKAENKAQKKVSAIGAWENSKKANLESELKKMEEQLEKKKAIYTEKMKNKIALLHKEAEEKRAMIEAKRGEDLLKAEELAAKYRATGTAPKKILGIF

SEQ ID NO: 318 - DNA, 525 bp, Lycopersicon esculentum
atggcagaagctactgcagttgcagctcaacctcaaccagaatcaacaactcctcctcccatggccaaatctgatgactctaaagctattgctactcttcccccaacaaagcctgactcttcaacaaagaaaagttcaaagggatccttcgacagagatgttgctctcgcacaccttgaagaagagaaaaggaattcctatatcaaggcatgggaagaaagtgaaaaaagcaaggtgaataacaaggccgagaagaagctctcgtcagttggaacatgggagaacaccaagaaagcaaatattgaagctaaactgaagaaacttgaggaacaactagagcaaaagaaggcagaatatgcagagaagattaaaaataaagtagctgcagttcacatggaggcagaggaaaagagagctatggttgaagcgagacgaggagaagaacttcttaaagcagaggagatagctgccaagtatcgtgctacgggacaagcccctaagaagattggatgccttggatgttaa

SEQ ID NO: 319 - protein, 174 aa, Lycopersicon esculentum
MAEATAVAAQPQPESTTPPPMAKSDDSKAIATLPPTKPDSSTKKSSKGSFDRDVALAHLEEEKRNSYIKAWEESEKSKVNNKAEKKLSSVGTWENTKKANIEAKLKKLEEQLEQKKAEYAEKIKNKVAAVHMEAEEKRAMVEARRGEELLKAEEIAAKYRATGQAPKKIGCLGC

SEQ ID NO: 320 - DNA, 402 bp, Medicago truncatula
atggcagagacacaagtaaaatcagaatcatcatctgatattgttctagcagaagtgaccaaagagaaaaagctatgttatgtgaaagcatgggaagaaagtgaaaaaaccaaagcagataacaaagctcacaagcacatctcttccattgctgcttgggaagacagcaaaaaggcagctctagaagctgagctcaaaaaaattgaggaacaactagagagaaagaaagcaagatatggtgaaataatgagaaacaagatagcattagttcacaaggaagcagaggagaagagggcaatgattgaagccaaacgaggtgaagaggttcttaaggtacaggaaatggctgctaaataccgtgcaactggaaccactccaaaaaagaccattggatgtttttga

SEQ ID NO: 321 - protein, 133 aa, Medicago truncatula
MAETQVKSESSSDIVLAEVTKEKKLCYVKAWEESEKTKADNKAHKHISSIAAWEDSKKAALEAELKKIEEQLERKKARYGEIMRNKIALVHKEAEEKRAMIEAKRGEEVLKVQEMAAKYRATGTTPKKTIGCF

SEQ ID NO: 322 - DNA, 819 bp, Musa acuminata
atgttgaatgatcacaggcaccaccaccatcacgccgccgccgctgctggtgatgatgatcacgacgaaggccccagcgacggcgccgagttccgtgacatccacgaattagctccccattcccaccccagccaaggccggcggagggagctgtgggagggcggcagccaccgatcggcctccctctccaccgggagcgacgccgccaacgacggcttcacgagcgtgagcagggagttcagcgcgatggtcgtcgccggctccgccatgcacaacggcggcggcagcaaccacgacaaccacgccgacgacgggctccagaaccagctcgcgcggatcggggaggacgagctggaggagacgaacccgctggcgatcgtccccgacaacaaccccatcccctctccccgtcggccgctgcctgctggggactccggcgccgccaaccctgccgacgaggtcccggtacacctggtgaagaaggaggaggtggagtcgaagatatcggcatggcagacggcggaggtctccaagatcaacaaccgcttcaagcgccaggaggtgaccatcaacgggtgggagaacgagaaggtggagaaagccacggcctggttgaagaaagtagagaggaaactggaggagcagcgggcgagggcgatggagaagatgcagaacgacgtggcgaaggcgcaccacaaggcagcggagaagcgggcgtcggcggaggccaagaggggaaccaaggttgccaaggtgctggaactggccaacttcatgagagctgtggggagagctccgtccaagcgctccttcttctag

SEQ ID NO: 323 - protein, 272 aa, Musa acuminata
MLNDHRHHHHHAAAAAGDDDHDEGPSDGAEFRDIHELAPHSHPSQGRRRELWEGGSHRSASLSTGSDAANDGFTSVSREFSAMVVAGSAMHNGGGSNHDNHADDGLQNQLARIGEDELEETNPLAIVPDNNPIPSPRRPLPAGDSGAANPADEVPVHLVKKEEVESKISAWQTAEVSKINNRFKRQEVTINGWENEKVEKATAWLKKVERKLEEQRARAMEKMQNDVAKAHHKAAEKRASAEAKRGTKVAKVLELANFMRAVGRAPSKRSFF

SEQ ID NO: 324 - DNA, 867 bp, Medicago truncatula
atgtcaaataattttctttcatcaaaccaatcagattcatattcttgttcatcttcttgttgtttaacaagaacattgaaaacaaagcgtggaaataaaaataagaagatgcatcgttctctcatcacagcattgcaagaatctccttcttctaattaccattctcttcctgatcctccctcatgctcagacaatgcgactcacttctccactccaagaaaccagagattaggcatggcccacattgaaaacaattgcttctctgatattgatgaatggttggaacatgccaataagttttgcaaatccttcttcaatcatcatcacactgaggaaaatcttgaagcagaaacaaggcaaaatggaaatccacaagacttgatgagaatgtcagcagtatgcaacaaggacctaacagctcaagagcatgaattttacaacatagtattaccctcagttagagaagaaagtccacttcctcgtactattacctcctgcataaacagacatggagggtgcagcagcaatcccaaacttgaagctgatcatgaagatgtacgtaacaaagccaagcatcttcaacttatgcacaggttgagaaagaaggaagaagctataaatgattgggaattgcaccaaaccaggaaagccatggataacatggataaaattcagaataagcttgaaaggaaacaagtaatggcttcagcaagggctcaaaagaaaatatactcagtaagggaaaaggcagagaagcaaaagctgaacttaaggcgatcaactatgaaaaagttccaacaactacaaatacatgagactcattcctcctcagatacttcatgggactcacatttgcctttatgttaa

SEQ ID NO: 325 - protein, 288 aa, Medicago truncatula
MSNNFLSSNQSDSYSCSSSCCLTRTLKTKRGNKNKKMHRSLITALQESPSSNYHSLPDPPSCSDNATHFSTPRNQRLGMAHIENNCFSDIDEWLEHANKFCKSFFNHHHTEENLEAETRQNGNPQDLMRMSAVCNKDLTAQEHEFYNIVLPSVREESPLPRTITSCINRHGGCSSNPKLEADHEDVRNKAKHLQLMHRLRKKEEAINDWELHQTRKAMDNMDKIQNKLERKQVMASARAQKKIYSVREKAEKQKLNLRRSTMKKFQQLQIHETHSSSDTSWDSHLPLC

SEQ ID NO: 326 - protein, 111 aa, Arabidopsis thaliana
VKREEVEAKITAWQTAKVAKINNRFKRQDAVINGWLNEQVHRANSWMKKIERKLEDRRAKAMEKTQNKVAKAQRKAEERRATAEGKRGTEVARVLEVANLMRAVGRPPAKR

SEQ ID NO: 327 - DNA, 56 bp, Artificial sequence
  primer: prm09186
ggggacaagtttgtacaaaaaagcaggcttaaacaatgttgactttgtacggtcaa

SEQ ID NO: 328 - DNA, 51 bp, Artificial sequence
  primer: prm09187
ggggaccactttgtacaagaaagctgggtagcttagctaggaaagagagaa

SEQ ID NO: 329 - DNA, 2194 bp, Oryza sativa; identical to SEQ ID NO: 39

SEQ ID NO: 330 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 331 - DNA, 1130 bp, Oryza sativa; identical to SEQ ID NO: 330

SEQ ID NO: 332 - DNA, 1242 bp, Zea mays
ggcacagacgctactggcacgcacgcacgcaccagcaccacaccacaccacatgcatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttctcgtcgtccgacgaccagcagtacatgacgatgagccgcgagttcacggccatggtcgccgccggggcgaccatgcagaccggcggctacgacggcgccgccgaccagctcaccagcatcggcgaggacgagctggaggagaccaacccgctggccatcgtccccgacagccaccccatcgccacgccagccaggtccagggcgtccgggctggaggtcgtgcccgcgggcccggcgccggcgccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcagcgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactacccccgtctctccctgcctgcgtgtgatcgatgtacgctcgctgctgcatccgagaacctaactgtaaagaaaaaaaaactgtaagctgtatacgtactgcgcctgctggttcccctgtgatgtctgtcagtgtcatccatcacagggtgccagttgttctcttctctttcttttcttttctcttctcttggcttgtatatcggatccatatatgctggtggtgcttgaacgaactgttgttgtttgcttaaccgtgcaaacatatacagtggtatatacactacattcagaacccaaaaaaaaaaaaaaaaa

SEQ ID NO: 333 - protein, 266 aa, Zea mays
MLHEQQAPPPAVAAPPPSINPDDDGGRDVEVTTFRDIHPLTPDAPPPASASWDTASHRSFSSSDDQQYMTMSREFTAMVAAGATMQTGGYDGAADQLTSIGEDELEETNPLAIVPDSHPIATPARSRASGLEVVPAGPAPAPQPPAHLEASQVKKEEVETKVTAWQTAEVAKINNRFKREDVVINGWETEQVEKASAWLKKIERKLDEQRAKALEKTQNDIAKARRKAEEKRASAEAKRGLKLAKVLELANFMKAVGRVPTKRSFF

SEQ ID NO: 334 - protein, 111 aa, Zea mays
VKKEEVETKVTAWQTAEVAKINNRFKREDVVINGWETEQVEKASAWLKKIERKLDEQRAKALEKTQNDIAKARRKAEEKRASAEAKRGLKLAKVLELANFMKAVGRVPTKR

SEQ ID NO: 335 - DNA, 920 bp, Oryza sativa
atcgccattaccacactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtccaccccacgcaccgacgacgacgaggagtccgccgccaccgacggcgacgagtcctcctccccggccagcgacctggcgttcgaactggacgtcctgagtgacatgggctgggacctgtactacgcgagcttggcgcaggggatgctcatggagccaccatcggcggcgctcggcgacgacggtgacgccatcctcgccgacgtcccactctggagctactagagctcaatcaactgtacaattttgcctcttttttctctcttttctggcttccgatgccaaaattttggtactgtacggacactactttcggtaatgtgatggaacaagttgcaaaacacagagc

SEQ ID NO: 336 - protein, 238 aa, Oryza sativa
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 337 - DNA, 52 bp, Artificial sequence
  primer 1
ggggacaagtttgtacaaaaaagcaggcttaaacaatgtgcgggatcaagca

SEQ ID NO: 338 - DNA, 51 bp, Artificial sequence
  primer 2
ggggaccactttgtacaagaaagctgggtggcaaaattgtacagttgattg

SEQ ID NO: 339 - DNA, 2194 bp, Oryza sativa; identical to SEQ ID NO: 39

SEQ ID NO: 340 - protein, 74 aa, Artificial sequence
  consensus sequence of an AP2 domain
  UNSURE (1)..(1): Xaa can be any naturally occurring amino acid
  VARIANT (2)..(2): Xaa is His, Trp, Tyr or Phe
  VARIANT (3)..(3): Xaa is Lys, Arg or His
  VARIANT (6)..(6): Xaa is Asp, Glu, His, Lys, Asn, Gln, Arg, Ser, Thr or Cys
  UNSURE (7)..(7): Xaa can be any naturally occurring amino acid
  VARIANT (8)..(8): Xaa is Lys, Arg or His
  UNSURE (9)..(9): Xaa can be any naturally occurring amino acid
  VARIANT (10)..(10): Xaa is Cys, Phe, Gly, His, Ile, Lys, Leu, Met, Arg, Thr, Val, Trp, Tyr or Ala
  UNSURE (12)..(12): Xaa can be any naturally occurring amino acid
  VARIANT (13)..(13): Xaa is Lys, Arg or His
  UNSURE (15)..(15): Xaa can be any naturally occurring amino acid
  VARIANT (16)..(16): Xaa is Gly, Ser or Ala
  VARIANT (17)..(17): Xaa is Glu, His, Lys, Arg or Asp
  VARIANT (19)..(19): Xaa is Cys, Asp, Glu, His, Lys, Asn, Gln, Arg, Ser, Thr or Ala
  VARIANT (20)..(20): Xaa is Glu, His, Lys, Arg or Asp
  VARIANT (21)..(21): Xaa is Cys, Asp, Gly, Asn, Pro, Ser, Thr, Val or Ala
  UNSURE (22)..(31): Xaa can be any naturally occurring amino acid
  VARIANT (32)..(33): Xaa is Cys, Asp, Glu, His, Lys, Asn, Gln, Arg, Ser, Thr or Ala
  VARIANT (34)..(34): Xaa is Glu, His, Lys, Arg or Asp
  VARIANT (35)..(35): Xaa is Leu or Val
  VARIANT (36)..(36): Xaa is His, Trp, Tyr or Phe
  VARIANT (39)..(39): Xaa is Thr or Ser
  VARIANT (42)..(42): Xaa is Thr or Ser
  VARIANT (43)..(43): Xaa is Cys, Asp, Glu, His, Lys, Asn, Gln, Arg, Ser, Thr or Ala
  VARIANT (44)..(44): Xaa is Glu or Asp
  VARIANT (45)..(45): Xaa is Cys, Asp, Glu, His, Lys, Asn, Gln, Arg, Ser, Thr or Ala
  VARIANT (48)..(48): Xaa is Cys, Phe, Gly, His, Ile, Lys, Leu, Met, Arg, Thr, Val, Trp Tyr or Ala
  UNSURE (52)..(52): Xaa can be any naturally occurring amino acid
  VARIANT (55)..(58): Xaa is Cys, Phe, Gly, His, Ile, Lys, Leu, Met, Arg, Thr, Val, Trp Tyr or Ala
  UNSURE (60)..(61): Xaa can be any naturally occurring amino acid
  VARIANT (63)..(63): Xaa is Asp, Glu, His, Lys, Asn, Gln, Arg, Ser, Thr or Ala
  VARIANT (64)..(65): Xaa is Cys, Phe, Gly, His, Ile, Lys, Leu, Met, Arg, Thr, Val, Trp Tyr or Ala
  VARIANT (68)..(68): Xaa is Cys, Asp, Gly, Asn, Pro, Ser, Thr, Val or Ala
  UNSURE (69)..(72): Xaa can be any naturally occurring amino acid
  VARIANT (73)..(74): Xaa is Cys, Asp, Glu, His, Lys, Asn, Gln, Arg, Ser, Thr or Ala
XXXGVXXXXAGXXWXXXIXDXXXXXXXXXXXXAXXXLGXFAXXXXAAXAYDXAAXXXXGXXCXXXNFXXXXXXX

SEQ ID NO: 341 - protein, 72 aa, Oryza sativa
VFRGVRRRGNAGRWVCEVRVPGRRGCRLWLGTFDTAEGAARAHDAAMLAINAGGGGGGGACCLNFADSAWLL

SEQ ID NO: 342 - DNA, 6 bp, Artificial sequence
  DREB protein DRE element
  variation (1)..(1): n is a or g
  variation (2)..(2): n is t or c
nncgac

SEQ ID NO: 343 - protein, 29 aa, Artificial sequence
  DREB protein CMIII-1 motif
PELAWSLPRPESTSPKDIQAAAAEAAAMF

SEQ ID NO: 344 - protein, 32 aa, Artificial sequence
  DREB protein CMIII-2 motif
QSCGAFFMDEEAMLGMPNLLANMAEGMLLPPP

SEQ ID NO: 345 - protein, 21 aa, Artificial sequence
  DREB protein CMIII-3 motif
DYDPTLAESCPKKPAGRKKFR

SEQ ID NO: 346 - protein, 26 aa, Artificial sequence
  DREB protein CMIII-4 motif
  UNSURE (18)..(18): Xaa can be any naturally occurring amino acid
  UNSURE (21)..(21): Xaa can be any naturally occurring amino acid
LWSYSEQIDNPKKPAGRXKFXETRHP

SEQ ID NO: 347 - protein, 16 aa, Artificial sequence
  DREB protein CMIII-3 motif region I
  VARIANT (3)..(3): Xaa is Arg or Lys
  UNSURE (8)..(8): Xaa can be any naturally occurring amino acid
  UNSURE (11)..(11): Xaa can be any naturally occurring amino acid
PKXPAGRXKFXETRHP

SEQ ID NO: 348 - protein, 5 aa, Artificial sequence
  DREB protein CMIII-3 motif region II
DSAWR

SEQ ID NO: 349 - protein, 8 aa, Artificial sequence
  DREB protein CMIV-1 motif
  VARIANT (1)..(1): Xaa is Arg or Lys
  VARIANT (7)..(7): Xaa can be any naturally occurring amino acid
XGKGGPXN

SEQ ID NO: 350 - protein, 41 aa, Artificial sequence
  DREB protein CMIV-2 motif
KKRKRRGGRDVAEILKKWKEYNEQVEADSCIDGGGPKKIRK

SEQ ID NO: 351 - DNA, 756 bp, Oryza sativa
atgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcgggagtcatcatcgtccgtgttcccactcgccatcgacgtcgtcgccgaggacgccatgtccgccacgtccgagccgtccgccgcgagcgacgacgacgccgtcaccagcagcagcagcacgaccgacgccgacgaggaggcatcaccgttcgagctggacgtggtgagcgacatgggctggagcctgtactacgcgagcttagcggagggcctcctcatggagccgccggcttccggcgcatcgtccgacgacgacgacgacgccatcgtcgactcaagcgacatcgctgacgtgtctctgtggagctactag

SEQ ID NO: 352 - protein, 251 aa, Oryza sativa
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 353 - DNA, 741 bp, Oryza sativa
atggacatggccggccacgaggtgaactccagctcgtcgtcgtcgggggcggagtcgtcgtcgtcctcgtcggggcggcagcagtacaagaagcggcccgcggggcgcaccaagttcagggagacgcggcacccggtgtaccgcggcgtgcggcgccgcggcggggcggggcggtgggtgtgcgaggtgcgcgtcccggggaagcgcggcgcgcgcctgtggctcggcacgtacgtcaccgccgaggccgcggcgcgcgcgcacgacgccgccatgatcgcgctccgcggcggcgccggcggaggcggcgcggcgtgcctcaacttccaggactccgcgtggctgctcgccgtcccgcccgccgcgccgtccgacctggccggcgtccgccgcgcggccaccgaggccgtcgcgggcttcctccagcgcaacaagaccacgaacggcgcctccgtcgcggaggccatggacgaggccacctccggcgtgtccgcgccgccgccgctggccaacaatgccggctcgtcggagacgcccggaccttcatcgatcgacggaacggctgacacggcggcgggggcggcgctggacatgttcgagctcgacttcttcggcgaaatggactacgacacgtactacgcgagcctggccgaggggcttctcatggagccgccgccggcggcgaccgcactctgggacaacggcgacgaaggcgctgacatcgcgctctggagctactga

SEQ ID NO: 354 - protein, 246 aa, Oryza sativa
MDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAMDEATSGVSAPPPLANNAGSSETPGPSSIDGTADTAAGAALDMFELDFFGEMDYDTYYASLAEGLLMEPPPAATALWDNGDEGADIALWSY

SEQ ID NO: 355 - DNA, 729 bp, Oryza sativa
atggacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctag

SEQ ID NO: 356 - protein, 182 aa, Oryza sativa
MDVARDMKNTTAMGMSSSATTAATATGASKRAGRTKTRHVRGVRRRGRAGRWVCVRVGSRGDRWVGTDTAAARAHDAAMACGASASNADSAWHVRAVASGHDDVRAASAVARRGSTAATATATSGDAASTASSSVSNDDNASSASTAVAAADHGDMGGMRTDYASAGTTAGCDDGCGGAMWS

SEQ ID NO: 357 - DNA, 904 bp, Oryza sativa
actgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaacc

SEQ ID NO: 358 - protein, 253 aa, Oryza sativa
MEKNTAASGQLMTSSAEATPSSPKRPAGRTKFQETRHLVFRGVRWRGCAGRWVCKVRVPGSRGDRFWIGTSDTAEETARTHDAAMLALCGASASLNFADSAWLLHVPRAPVVSGLRPPAARCATRCLQGHRRVPAPGRGSTATATATSGDAASTAPPSAPVLSAKQCEFIFLSSLDCWMLMSKLISSSRAKGSLCLRKNPISFCMVTNSYTALLLEYIILQMNSMIVLIHELSKYQVFLLLTMITHHLFQWRR

SEQ ID NO: 359 - DNA, 897 bp, Oryza sativa
cagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccaacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggcgcaggggctgctcgtcgagccgccggccgccggagcgtggtgggaggacggcgagctcgccggctccgacatgccgctctggagctactaatcaaaatctcgcactgaaaagtgtggacaaattttgattctccagaaattgggggaaaaaagagaacagagtattggtgaatttagaacagagtaggcaatgagactgaggatgaatggcaatttttgtaattttggaatgtgccagatttctccctccttttgtgattccatctgattttgaatgtgcagtcaatgaattcctgtaaatttacttctcctctcc

SEQ ID NO: 360 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 361 - DNA, 1272 bp, Oryza sativa
agaattcaaaccggatcaacctcgctcgcttactcgtgtttaggcatggacgtttctgctgcgctcagcagcgactactcgtcggggacgccgtcgccggtggcggccgacgccgacgacggctcctccgcctacatgacggtgtcgtcggcgccgcccaagcggcgagcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctatctcgacatggcgcaagggatgctcattgacccgcctccaatggccggtgatcctgccgtaggtagcggcgaagacgacaacgatggcgaggtccagctatggagctactgatcctgcgcgtttgaactcaacttggtttggcgcgaagagatcgcatgtacagcttaagggagtcgagtacaagtacctcaggtgtactccactcgttgcccctttcccttccctttcgtttttcttgagcttatctgcagggtaatgttatgtattgctgctcttctgatgaaatgtgatcggaagaagcggaaggccagatcgagcttatgggttctgaagacggtgaaggcttgtcgagtgttgtgagcatatattcagaaagtcaggcactgtgaaagtatgaatcagatcagccttgttacgaatgagagtgatcgaccttgttcagtgtttataattgaaccacttgtgtgtaataagcagcaaagccatgttgcttgcttgatctgactcttgggaatggtatatttctcaaagaatgcaggattgactactcagaatttgacattttgcagtgaaatgataggattgttaaattaacattggaggagaggcatgtgtatatatgttaagaaacattagtaatgatgagcctatgatacttcgatc

SEQ ID NO: 362 - protein, 224 aa, Oryza sativa
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMAGDPAVGSGEDDNDGEVQLWSY

SEQ ID NO: 363 - DNA, 764 bp, Oryza sativa
ccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttt

SEQ ID NO: 364 - protein, 214 aa, Oryza sativa
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 365 - DNA, 862 bp, Oryza sativa
catccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggcgcaggggctgctcgtcgagccgccggccgccggagcgtggtgggaggacggcgagctcgccggctccgatatgccgctctggagctactaatcaaaatctcgcactgaaaagtgtggacaaattttgattctccagaaattgggggaaaaaagagaacagagtattggtgaatttagaacagagtaggcaatgagactgaggatgaatggcatttttgtaattttggaatgtgccagatttctccctccttttgtgattccatctgattttgaatgtgcagtcatgaattc

SEQ ID NO: 366 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 367 - DNA, 699 bp, Zea mays
atggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgcggcggcgatgtacggcggcggcatggagttcgaccactcgtattgctacgacgacgggatggtgagcgggagcagcgactgctggcaaagcggcgccggcgccggtggatggcatagcatcgtggacggcgactacgacgacggcgccagcgacatgacgctctggagctactga

SEQ ID NO: 368 - protein, 232 aa, Zea mays
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAMYGGGMEFDHSYCYDDGMVSGSSDCWQSGAGAGGWHSIVDGDYDDGASDMTLWSY

SEQ ID NO: 369 - DNA, 696 bp, Zea mays
atgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggaggacttcctccgccatcaggtggtcccggaggacgacgccctcgcggccacgccgtcgtcgccttccagcgaagacggcagcacctctgatggcggggagtcctcctctgattcctctccgcccaccggggcctcgccgttcgaattggatgtgttcaacgacatgagctgggacctgcactacgcgagcttggcgcagggattgctcgtggagccaccgtccgcggtcacggcgctcatggacgaaggcttcgccgatgtgccgctctggagctactag

SEQ ID NO: 370 - protein, 231 aa, Zea mays
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVEDFLRHQVVPEDDALAATPSSPSSEDGSTSDGGESSSDSSPPTGASPFELDVFNDMSWDLHYASLAQGLLVEPPSAVTALMDEGFADVPLWSY

SEQ ID NO: 371 - DNA, 1085 bp, Zea mays
gctcaagctcgagacaagaaaccagaaccagctcactcctcactccacttccactcccaacagcaagctcaagcagtcagtcaccggcaggggtcagggtcacagtcacagcagcagccatggacacggccggcctcgtccagcacgcgacctcctcgtcttccacctccacctcggcgtcgtcgtcctcgtccgagcagcagagccgcaaggcggcgtggccgccgtcgaccgcttcctcaccacagcagccgcccaagaagcgccccgcggggcgcacaaagttccgggagacgcggcacccggtgttccgcggcgtgcggcggcggggcgccgcgggccggtgggtgtgcgaggtgcgcgtcccggggaggcgcggcgcgcggctgtggctcggcacctacctcgccgccgaggcggcggcgcgcgcgcacgacgccgcgatactcgccctgcagggccgcggcgcggggcgcctcaacttcccggactccgcgcggctgctcgccgtgccgcccccgtccgcgctcccgggcctggacgacgcccgccgcgcggcgctcgaggccgtcgcggagttccagcgccgctctgggtccgggtccggggccgccgacgaagcgacctcgggcgcgtctcctccctcctcgtcgccgtcgctgccggacgtttctgcggctggctcgccggcggcggcgcttgagcacgtgcctgtgaaggccgacgaagcagtggcgttggacttggacggcgacgtgttcgggcccgactggttcggggacatgggcctggagttggatgcgtactacgccagcctcgcggaagggttgctcgtggagccgccgccgccgccggcggcctgggatcatggagactgctgtgactccggagctgcggacgtcgcgctctggagctactactagcaaagttaacaataataagcttgacagccaaccccaaaagccccccaactgattgtattcacctctgtaacaaaattcaaattgatttcccagcaaatgaacttcaaaagaagtctttggttccgatttaaaaaaaaaaaaaaaaaaaaaaaaaaaaaaaaa

SEQ ID NO: 372 - protein, 267 aa, Zea mays
MDTAGLVQHATSSSSTSTSASSSSSEQQSRKAAWPPSTASSPQQPPKKRPAGRTKFRETRHPVFRGVRRRGAAGRWVCEVRVPGRRGARLWLGTYLAAEAAARAHDAAILALQGRGAGRLNFPDSARLLAVPPPSALPGLDDARRAALEAVAEFQRRSGSGSGAADEATSGASPPSSSPSLPDVSAAGSPAAALEHVPVKADEAVALDLDGDVFGPDWFGDMGLELDAYYASLAEGLLVEPPPPPAAWDHGDCCDSGAADVALWSYY

SEQ ID NO: 373 - DNA, 846 bp, Zea mays
atggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggagggaagctgtgctggtaataaagcggcgccggccaagaagcgaccgcggggcagcgaggggaaacacccgacgttccgcggcgtgcggatgcgggcgtggggcaagtgggtgtcggagatccgcgagccgcgcaagaagtcgcgcatatggctcggcacgttccccaccgccgagatggccgcgcgcgcccacgacgtcgcggcgctcgccatcaaaggccgcgccgcgcacctcaacttcccggacttcgccggcgcgctcccgcgcgccgcgtccgcggcgcccaaggacgtccaggcagccgccgcattggccgctgcgttcacgtcgccgtcatcggagcccggcgccggcgcgcacgaggagcccgctgccaaggacggcgccgcgcccgaggaggcagccgccgacgcacaggcaccagtaccagtagcactaccaccgccggcggcctctcggccagggacgccgtcgagcggcgtggaggacgagcggcagctgttcgacctgccggacctgctcctcgacatccgggacgggttcgggcgcttcccgccgatgtgggccccgctcactgacgtggaggaggtggtcaatgcggagctgcgcctcgaggagccgctgctttgggagtag

SEQ ID NO: 374 - protein, 281 aa, Zea mays
MAQELHETSSCSATTTSSCTTSCCSSTVTDSSSSPPSPAAANAAPATRKRQALEAEAEAEAGGEEEEEEEGSCAGNKAAPAKKRPRGSEGKHPTFRGVRMRAWGKWVSEIREPRKKSRIWLGTFPTAEMAARAHDVAALAIKGRAAHLNFPDFAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 375 - DNA, 1455 bp, Zea mays
cactcagactcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgcccccgcccccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaaaaaaaaaccgaggtcgatgatgaggatggcggtagtgacgaggataacgacgacgacgagtaaatagtatttccgctgttgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccgaatgctgctagctattatgttgcttttcttttgctaatcacttgtgtcacaactttctgtacctgtttcattgactaatctagtgactagtcagttatgggtttaatgtttggttttggttttatatatttctttgttgcattctgtgcggtctacggaagtcatctgtgctgtatgaatgatgaatatctgcttgtggctcgtttcagtttagtgagtttttgttttgtgactcaggttaatttacatgagtttgtttgtgactgtt

SEQ ID NO: 376 - protein, 246 aa, Zea mays
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 377 - DNA, 800 bp, Triticum aestivum
tttttgacgctgcaactgatggacaccgccgctgccggctccccgcgtgaggggcacaggacggtgtgctcggagccgcccaagaggccggcagggcggaccaagttcagggagacgcgccacccgctgtaccgcggcgtgcggcgccggggccggctcgggcagtgggtgtgcgaggttcgcgtgcgcggcgcgcaagggtacaggctctggctcggcaccttcaccactgccgagatggcggcgcgcgcgcacgactccgccgtgctcgcgctcctcgaccgcgccgcctgcctcaacttcgccgactccgcctggcggatgctgcccgtcctcgcggctggctcgtcccgcttcagcagcgcgcgggagatcaaggacgccgtcgccatcgccgtcctggagttccagcggcagcgccccgtcgtgtcaacgtcggagatgcacgacggcgaaaaggacgcccaaggctcgccgacgccgagcgagctgtccacgtccagcgacttgttggacgagcactggtttggcggcatggacgccggctcgtactacgcgagcttggcgcaggggatgctcatggagccgccgtccgccagaacgtggagcgaggatggcggcgaatacagcgccgtctacacgccgctttggaactaattatccgactaattaagccatgtacagttttggaaactactccctcggtaaactaatataagagcatttaaatcattaaaatagtgatctaaacactcttatattaagtttacggagggagtaggctactagtggttgtgttg

SEQ ID NO: 378 - protein, 212 aa, Triticum aestivum
MDTAAAGSPREGHRTVCSEPPKRPAGRTKFRETRHPLYRGVRRRGRLGQWVCEVRVRGAQGYRLWLGTFTTAEMAARAHDSAVLALLDRAACLNFADSAWRMLPVLAAGSSRFSSAREIKDAVAIAVLEFQRQRPVVSTSEMHDGEKDAQGSPTPSELSTSSDLLDEHWFGGMDAGSYYASLAQGMLMEPPSARTWSEDGGEYSAVYTPLWN

SEQ ID NO: 379 - DNA, 945 bp, Triticum aestivum
ccacctcgttacaccacaaaccactctcaacgccagctgcgaccgatggacaccaacgccgcctggccgcagtttgacgggcaagagtacaggacggtgtggccggaggagcaggagtaccggacggtgtggtcggagccgccgaagcggcgggcggggcggaacaagttgcaggagacacgccacccagtgtaccgcggcgtgcgccgccgtggccgggaagggcagtgggtgtgcgagctgcgcgtgccggccggaagccggagttactccaggatctggcttggcaccttcgccagtgcccagatggcggcgcgcgcgcacgactcggccgcgctcgcgctctccggccgcgacgcgtgcctcaacttcgccgactccgcctggcggatgatgcccgtccacgcagccgggtcgttcaagttggccgccgcgcaggagatcaaggacgccgtcgccgtggccctcaaggagttccaggagcagcagcgccctgccgacgagtcaacggcgccgtcgtccacggccgaggagagcgcgctctccatcatccccagcgacctgtcggggctcgacaatgagcactggatcggcggcatggaggccgggtcgtactacgcgagcttggcgcaggggatgctcatggagccgccggccgacggagcttggcaggaggaccgcgaacacgacgacggattcgacacgtcgctgtggagctactagtgtgatcaactgattaagcaatgtaaagatctagagagtactgctagtgctagattgtgtttcaccaaatatgggaagaagagagagtaagcatcgggggaaaggtttccccccaatgtgaaagcgctcggtttctactcccggaagggcacaaatgagcttctttctttatttaataaataaatagagaaatgagcagcaaaaaaaaaaaaaaaaaaaaaa

SEQ ID NO: 380 - protein, 225 aa, Triticum aestivum
MDTNAAWPQFDGQEYRTVWPEEQEYRTVWSEPPKRRAGRNKLQETRHPVYRGVRRRGREGQWVCELRVPAGSRSYSRIWLGTFASAQMAARAHDSAALALSGRDACLNFADSAWRMMPVHAAGSFKLAAAQEIKDAVAVALKEFQEQQRPADESTAPSSTAEESALSIIPSDLSGLDNEHWIGGMEAGSYYASLAQGMLMEPPADGAWQEDREHDDGFDTSLWSY

SEQ ID NO: 381 - DNA, 1971 bp, Triticum monococcum
aagcttcaagaattagttatttttacatatagaccgtgtattgaagatgttctaagtggtgctcctttgtgccttccgtccccctagtactcggggaaccagacgaccccatgcagcagtgactgctgccttctctttgcagccgaacagccggcggaccaatcagtcaaggcaatcaccgctgcattaagccagcacgaagctgcctttttttgcttaacactgcgaagccaaaagcccccacacgcccaccaggagagaagtcacacgacgctatcaccccacagtccctttgtcaccagctgtccggacaccgcatccctcccgccgtcccaagcgcgttcatacacttgaacctccagcatcacgcatacctatatataaggaagtatcccacactctcgctcaagctcaacaagctagctcacactcctcagtcctccgtaagctcaagcagcaagctcgactgctcaagcaggaatccaccagccaatcacccagcactcagccggcagccatggacatgggccttgaggtctcgagctcctccccgtcctcctcgtcggcgtcgtcctcgcccgagcacgcggcggggcgggcgtcgctggccaagcgccccgcggggcgcaccaagttccgggagacgcggcacccggtgtaccgcggcgtgcggcgccggggcaacgccgagcggtgggtctgcgaggtgcgcgtccccggcaagcgcggcgcgaggctctggctcgggacgtacgccacggccgagatcgcggcgcgcgccaacgacgccgccatgctcgccctgggcggccgctccgccgcgtgcctcaacttcgcggactccgcgtggctgctcgccgtgccgcccgcactcgccgacctcggcgacgtccggcgcgcggcggtcgaggccgtcgctgatttccagagacgagaggctgccaacggctccctcacagtcaccgccaccgtcaccgaagaggcctcctgtggcgctcctgaagaatcgtcgtctgagtctgacagtgtcggttcgtcggagacgtcggaaccttctgccgatggagagttcgaggtgccggtcgcggtggacaccgatatgttcaggcttgacttgttcccggaactggatctgtgctcgtactacgcgagcctcgcggaggcgctgctcgtggacccgccggcaccggtgaccaccacctacgcgtactgggacaacggcgacggcggagctgatgtcgcgctctggagctactagctagtacagtcgataattcccctcgcaaaaaaaaagtagtgccgataattcccagctctgtagctatttttcccctgttacaaagttttccccttgtgggaaaagactatgtacgtagtactcctaactaataaggtgaagctgctcctaattcaatactccctctatccgaaaatacttgtcatcaaaataaataaataaaaatgtatctaaatgtattttagttttaaatatattttttttgttcattttaatgacaagtattttcggacggagagagtacttaactgtgaaacgggtttactcgtataaaatcttttgccactgataggtcactattcccacgccggcccttgactccctgaaatgtacatacatgtagtttcaaacaataaaaaggagcacaaaaacggcaactcacagcagatactttgtttttttgacagaaaagtttattttattaatcaaaggatagcaacatcgtttgccaacaggtttacaatgaaattgcgggtcatcaacccagcgagatggattattagcatgaccccaacatgctaactcatgagctacattatttaactctctaatacaatgctcaatagtttttttaaaaaaggaggatgatccccggcctctgcatctgtgagatgcatacgaccactttattgattattttcaaggaccttataaagcgttacaacaataagctt

SEQ ID NO: 382 - protein, 246 aa, Triticum monococcum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLGDVRRAAVEAVADFQRREAANGSLTVTATVTEEASCGAPEESSSESDSVGSSETSEPSADGEFEVPVAVDTDMFRLDLFPELDLCSYYASLAEALLVDPPAPVTTTYAYWDNGDGGADVALWSY

SEQ ID NO: 383 - DNA, 639 bp, Triticum monococcum
ttagctccacaacggcgtctgcgtctccgccacgccgctgtgctcgctgtcctctcgccaggctccggcgtccggcggctccacgagcatcccctgcgccaagctctcgtagtacgacccggcaaccatgccgccaaaccactgctcgtcgtcgagctccagcaagtcgcctgacgacatggagaacagcgcgccgctcggggcgacggccggctccgctgccgggcacgcgactggaagaacgatctgctgccgctggaacgcgaggacggcgacggcgacggcggtcttgatctcccgcgcgctgccgaagccgaaggagccggccgcgagcacgggcagcatccgccaggcggagtcggcgaagttgaggcaggctttgcggccggagagcgcgagcacggcggcgtcgtgggcgcgcgccgccatctcggcggtgacgaaggtgccgagccagagcctggatcccctcatcccgagcacgcgcacctcgcagacccaccgcccggcgggcccccgctggcgcacgccgcggtacagcgggtggcgcgtctcctggaacttggtccgccccgcgggccgcttcggcggctccgacctcaccgtcctgtgccgctgctcctcctgaccagacggcat

SEQ ID NO: 384 - protein, 212 aa, Triticum monococcum
MPSGQEEQRHRTVRSEPPKRPAGRTKFQETRHPLYRGVRQRGPAGRWVCEVRVLGMRGSRLWLGTFVTAEMAARAHDAAVLALSGRKACLNFADSAWRMLPVLAAGSFGFGSAREIKTAVAVAVLAFQRQQIVLPVACPAAEPAVAPSGALFSMSSGDLLELDDEQWFGGMVAGSYYESLAQGMLVEPPDAGAWREDSEHSGVAETQTPLWS

SEQ ID NO: 385 - DNA, 2148 bp, Triticum monococcum
aagcttcagcatgaatggcgaaaatgcacgtgaagaagctccgatcggtaggacgtaacagacgggcacaaatggacaaagagtgctcgaccaacctataaacaaacaataggcgaaaaaaccacgtatctgtttgtgtcggcgcgtcggagtgctctaacctctatgcaacaaagagtcgccgcgttaaggcgggcgggcgggcggcaggcacatggcgtcccgcctcggcacctcgtgtcagcccggcagccccgccacgtaccaaagagcacgcaaaagggcaaggttaacctgacgtgcgccgcgccacgccggggatcgtcgttatcgccgcccggcgtgggcgcgcagacgcgcagtcagttgacaggccgaagcaccgtccgtcccacgcaggcacgcagctgctctgcgggacagagtaccagtactaggataataacggcgggccgtggacgcgttcgggcgggcggcgccagggcacgagccgccgcccatccgtccctgccgcacgtgctttcctcgagatccggagctctaccagtacaccatagtctgacccactgacacagtacgatgccggccggccaagaccagcagaaaatcccgtctctgtcgccgtctccacgtggcctctcccccttccggtcgccttgcttccgatgcaaagtgtgcaattccgaactcttctagttgtagccttgtatactccgcgcgaagctagcccgccacgccaacgcagccggcctccctccgccaccgtgtcccgcgacgcgccgcccattcggacccgccacgcgccccggccgaatcctatatacacacgtcgctctcctcgctccctccctcccgatcatacaaacctcgatcacaagccaacaccattgattcgctagctacagtgtctgcagataagcaaacgatcgatccgtgcaagatggacaactccggcgtggtcttctatggcggcgcatacgcgacggtgatgtcggcgccgccgaagcggccggcggggcggaccaagttccgggagacgcgccacccggtgtaccgcggcgtgcgccggcgcggcgccgcggggcgctgggtgtgcgaggtgcgccagcccaacaacaagtcccgcatctggctcggcaccttcgccagccccgaggccgccgcgcgcgcccacgacgtcgccgcgctcgcgctccggggccgcgccgcctgcctcaacttcgccgactcggccgcgctgctcgccgtcgacccggccacgctccgcacgccccaggacatcagagccgccgcaatcacgctcgcccagacggcctgcccgcacgacgcgccgaggtcctctgtgtccgcggcgtctgcgccggcgcccgcgatggtgatcacgcaggaggccgcggctgcgccgtacgacagctacgccatgtacggcggcttggcggacctggaacagcattcccactgctactacgacgggatgagcggcagcggcgactggcagagcatctcacacatgaacgtcgccgacgaagacggtggctacggcgcaggagacgtcgcgctctggagctactgatcgagtgggattgatctggcagtttgttgagcacgattcgtttgctcctgagtcctccgaaatccacgatcgataggggagtggcgtatggacgcacaccatattcgcatgagctagtttcaagcacgcgtactctgctttcccatgttcttgaaaattggcgctaaaactacacacgtgagctagttttggtaggggtatagtgctaggaaatatatgcagccagtttgctgagcggttacagacaatttatacctcactcgagatttttttttcccttccatgtaaatagctctgtcaaaagtaatatactctaccttgtaaatactgcagatccttaatttgatcttttttctctttaaaatgatgagagcaattataaagattcaccaaagcaaagcacctcaaacataataaaagatacatcgagatccatgaacaatcaaaccaccgccgccgccgtcaaaacaagccattgaatcctttatttgatctgaggaatctgacacgaaatctcgtcgttgcgggtgccctgacctcgccgcccaagaagctggcagaatatgcccaagctt

SEQ ID NO: 386 - protein, 210 aa, Triticum monococcum
MDNSGVVFYGGAYATVMSAPPKRPAGRTKFRETRHPVYRGVRRRGAAGRWVCEVRQPNNKSRIWLGTFASPEAAARAHDVAALALRGRAACLNFADSAALLAVDPATLRTPQDIRAAAITLAQTACPHDAPRSSVSAASAPAPAMVITQEAAAAPYDSYAMYGGLADLEQHSHCYYDGMSGSGDWQSISHMNVADEDGGYGAGDVALWSY

SEQ ID NO: 387 - DNA, 912 bp, Gossypium hirsutum
tctacctactacgcatacatacatgcacgcaaatgtagaatcacagatatggccaatttgtcccccgaagtgaacccaccaacccctcaaatccccgactctacgctcgatcttgtgcagttgccaaatcacagcaacctaccttccatcccgacgccaaaccctgttcaatatagctggcctggttccggaaggcattctagttatcggggaatacgaagcaggagcggcaaatgggtatctgaaatacgcgagccgcgtaaaaccacgcgtatatggctcggaacgtaccccactcctgaaatggcagccaccgcgtatgatgtggctgctattgctctaaaaggtcccgacacggatttgaactttccggatatgattctttcgtatccaaaagtggcttctacatccgcagccgatattcgagcggctgctgctagtgctgccgcttccaggctacccatgccagatacggggtcatcaaaacaggatcaaggcaaccttcaaaatgagggtaccgcgtcgacgtttagcacttgcatggagtctggttcaggtcaggaatatattgacgaggaagagcttttaaactttcccaatttgatggtggacatggcaggaggaatgctcgtaacccctcccaggatcaactcactcgcttcagatgattcaccagagatttcagatatagaaagcctatggacttatccttaaaggggctctaaatttactgagatagcagaaagtacaaaataagaaatgtgattgaaaaagtagatgagatgatcacaaatgtgaaggtatttgtcctttttgatctcttttgggctgtttctgtcatgccctgtatctgtatgcattcctgagtattgctagttaaagtttgcttgaggtaaactaaaaaaaaaaaaa

SEQ ID NO: 388 - protein, 221 aa, Gossypium hirsutum
MANLSPEVNPPTPQIPDSTLDLVQLPNHSNLPSIPTPNPVQYSWPGSGRHSSYRGIRSRSGKWVSEIREPRKTTRIWLGTYPTPEMAATAYDVAAIALKGPDTDLNFPDMILSYPKVASTSAADIRAAAASAAASRLPMPDTGSSKQDQGNLQNEGTASTFSTCMESGSGQEYIDEEELLNFPNLMVDMAGGMLVTPPRINSLASDDSPEISDIESLWTYP

SEQ ID NO: 389 - DNA, 1064 bp, Gossypium hirsutum
cattactcatgattcaaatttctgccatattacacacaaacaatggctgaatctgatccttcttcaaccaatgtgcccccgaaagaccagccaccaccaccaactgttccaatccctgacgctcctccgcaagagcagtcgccgaaaccatcatccactccattggtctcatcgaaagaaggcgtaagtgggaatcccacatcgagaaagttgtcggcggtttatcggggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaagtctgttaccaatactgggtccttatcaaaaaacgaggacaccacatcgactactgctatggagattacctgttcaggtcaagaatttatcgacgaggaagagcttttaaactttcccaatttggtggtggatatggcagggggaatgctagttagccctccaaactggataaactcaccaccttctgatgattcaccagataattcagatgtagatacactatggacttacacttaaaatagaaaaattcactgtaaaagtgatgaatgagagagagtataaagtccaatgaaatgtagaagaagaagcatggtttgaaaactagggtctagatgctactgatgattcagtaatatgaaatgcagaaggtactgtcatttgtccttttttttccctctgtcccttctggtttttatctcttttaggggttgttccattgctggaaaaacatatgaacaaatcagaagccaatataagaagaatctgagtggttttacatatctgttgcaatattgatgctattataaagcttgggttttcttttgtttttttaaaaaaaaaaaaaaaaaaaaaaaaaa

SEQ ID NO: 390 - protein, 226 aa, Gossypium hirsutum
MAESDPSSTNVPPKDQPPPPTVPIPDAPPQEQSPKPSSTPLVSSKEGVSGNPTSRKLSAVYRGVRSRSGKWVSEIREPRKTTRIWLGTYPTPEMAATAYDVAALALKGPDAELNFPDMVHSYPKVGSTSATDIRAAAASAAASRLLPKSVTNTGSLSKNEDTTSTTAMEITCSGQEFIDEEELLNFPNLVVDMAGGMLVSPPNWINSPPSDDSPDNSDVDTLWTYT

SEQ ID NO: 391 - DNA, 1102 bp, Gossypium hirsutum
ggccattacggccggggagaaaaagaaagctcatttagttaatattttcccttgcatttccaaattcggaagttcatacagcaagtgatttcctaaaatacttggatcctaagtacgaatatccttttcttgaaatatactctttttaagtcaaaagctttgtttaactgaaacttaaactgattactgtttgggttttttttttaaatggattttgtagttcaagattatgatatggttgattctgggtcggtttctgaaagtggaactgatcgtccggtgaatttttccgatgaatatgtgatgttagcttcgagttatccaaagaggcccgcgggaaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatggagaaagggttttacttggacgaagaagcgttgtttgggacacaaagattttgggcaaatatggctgccggtatgatgatgtcacctcctcgttccggtcatgacggaggatgggaggaacatgaagtcgatgattatgtacctttatggagttattctatttaaaagtaaaatttttcagacattttcaagcattcattggaatttttagttcacagaaatcgccaccggcaattgccctttatgttttgtacgtacaacgatttttttggattgtacgggtagtgctgtaagtaaaaagattaatgtgtatatatacgatgtatatatacttcatagcttctccaaacaataaatttatagcttcatatctattttaccatcaaaaaaaaaaaaaaaaaaaaaaaaa

SEQ ID NO: 392 - protein, 216 aa, Gossypium hirsutum
MDFVVQDYDMVDSGSVSESGTDRPVNFSDEYVMLASSYPKRPAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 393 - DNA, 888 bp, Gossypium hirsutum
atggattttgtagttcaagattatgacatggttgatttcgggtcggtttctgaaagtggaactgatcgtccggtgaatttttccgatgactatatgatgttagcttcgagttatccaaagaggcgagctgggaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatgcagaaagggttttacttggacgaagaagcgttgtttgggacacaaagattttgggcaaatatggctgccggtatgatgatgtcacctcctcgttccggtcatgacggaggatgggaagaacatgaagtcgatgattatgtacctttatggagttattctatttaaaagtaattttttcagacattttcaagcattcattggaatttttagttcgtagaaatcgccaccggcaattgccctttatgttttgtacgtacaacggtttttttggattgtacgggtagtgttgtaagtaaaaagattaatgtgtatatatacgatgtatatatacgtcataacttctccaaacaataaatttatagcttcatatccaaaaaaaaaaaaaaaaaaaaaaaaaaaaaa

SEQ ID NO: 394 - protein, 216 aa, Gossypium hirsutum
MDFVVQDYDMVDFGSVSESGTDRPVNFSDDYMMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMQKGFYLDEEALFGTQRFWANMAAGMMMSPPRSGHDGGWEEHEVDDYVPLWSYSI

SEQ ID NO: 395 - DNA, 1049 bp, Gossypium hirsutum
attttcccttgcatttccaaattcggaagttcatacagcaagcgatttcctaaaatacttggatactaagagcgaatatccttttcttgaaatatactcttttcaagtcaaaagctttgtttaactggaacttaaactgatttactgtttgggtttttttaaaatggattttttagttcaagattatgatatggttgattctgggtcggtttctgaaagtggaactgatcgtccggtgaatttttccgatggctatgtgatgttagcttcgagttatccaaagaggcgagctgggaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatggagaaagggttttacttggacgaagaagcgttgtttgggacacaaagattttgggcaaatatggctgccggtatgatgatgtcacctcctcgttccggtcatgacggaggatgggaagaacatgaagtcgatgattatgtacctttatggagttattctatttaaaagtaaaatttttcagacattttcaagcattcattggaatttttagttcacagaaatcgccaccggcaattgccctttatgttttgtacgtacaacgatttttttggattgtacgggtagtgctgtaagtaaaaagattaatgtgtatatatacgatgtatatatacttcatagcttctccaaacaataaatttatagcttcatatctattttaccatcaaaaaaaaaaaaaaaa

SEQ ID NO: 396 - protein, 216 aa, Gossypium hirsutum
MDFLVQDYDMVDSGSVSESGTDRPVNFSDGYVMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 397 - DNA, 480 bp, Glycine max
atggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgccaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagattag

SEQ ID NO: 398 - protein, 159 aa, Glycine max
MEEAGLGDCCSSNTTITRKSEKRKQQHQQQEKPYRGIRMRKWGKWVAEIREPNKRSRIWLGSYATPVAAARAYDTAVFHLRGPSARLNFPELLSQDDDVSTQQQGKMSADSIRQKATQVGARVDALQTALQQSSSTHSISSSHVSYEKPDLNEYPKPED

SEQ ID NO: 399 - DNA, 1026 bp, Glycine max
gcaaagtttccaaattgaatgcaaaaacagaaacttcttcctcaaatgccttctgggtcgctcttctttctatccagattacgaagatttcggtcgccagttgtgattcaagtgctattttagcattttttttttacctggacggtaagggtcaacttgcatgcacatgttagtgaaaaaccacaataagggggatggatctaagtccctggccgatacactggcgaaatggaaagaatataatgcctggctggagtctaacaatgaagctgagaagccggttaggaaggtccctgccaagggatcaaagaagggatgtatgaaaggcaaaggaggacctgagaacttgcgctgtaattacagaggagttaggcaaaggacatggggaaaatgggttgctgaaatccgagagccaaacagaggaagtaggctctggttgggtacttttcctactgccattagcgctgctcttgcttatgatgaagcagcgatggcaatgtatggtttctgtgcacgcctcaactttcccaatgttcaagtttcaactttttccgaggaaccgtctagaaattctccagctgctgcttaccagtcaagaaattctccatctgctaaagaatccggttctgcgttggtgatattagagaggtctgagtgcatgatgttgtggaacaattctggtggagatgcagcagaggatgatggcatggaagacctttccttatccttaagtgtgaaacatgaggaaggggaggatgaatcagggaccagttcttcctatctttcattgtcttgatgtatggtttgcatactctgatttggccgtggctggaaatcatagccttcatagaggtggatgattagcttaggatgaacgaatcttgatattagtacctggagattagctgttgtaaaattgacttggttgagaagtgttccattcttcaggaattgacctaatgcaatctggatatccagtcaagttgtaagatgtgaaatgtattttgccttgcatgatagatgact

SEQ ID NO: 400 - protein, 211 aa, Glycine max
MHMLVKNHNKGDGSKSLADTLAKWKEYNAWLESNNEAEKPVRKVPAKGSKKGCMKGKGGPENLRCNYRGVRQRTWGKWVAEIREPNRGSRLWLGTFPTAISAALAYDEAAMAMYGFCARLNFPNVQVSTFSEEPSRNSPAAAYQSRNSPSAKESGSALVILERSECMMLWNNSGGDAAEDDGMEDLSLSLSVKHEEGEDESGTSSSYLSLS

SEQ ID NO: 401 - DNA, 1077 bp, Glycine max
gttttggaattgagacaggctttatttataattttaaaaacttgtttccctccctcccttatttttgggttttctcaacttgttcttgtcatcttgtaaaacatgggaactgctatagacatgtacaacagcagcaacatcgtagcggatttcctagatccgtatagtgaagagctgatgaaagcacttaagccttttatgaaaagtgattatttctctgcctcttcttcttcttcactcgaatcacagccttgttctttttcatctaattctctccccacttcgtatccctcttccaaccaaatcaagctcaaccaactcaccccagaccaaattgttcagattcaggcccaaatccacattcagcagcagcagcagcacgtggcccaaacccaaacccacctgggcccaaaacgcgtccccatgaagcacgctggcacggccgcgaaacccacgaagctctaccgcggggtgcggcaacggcattggggcaagtgggtcgctgaaatcagactcccaaagaaccgcacgcgcctctggctaggaacattcgacaccgcagaggaagcagcattagcgtacgacaacgcagcgtttaagctcagaggcgagttcgcgcgtctcaattttcctcatctaagacaccacggagccttcgttttcggcgagttcggagattacaagcctctaccttcttccgtggattccaaactgcaagctatttgcgaaagcttagcgaaacaagaggaaaagccgtgttgctccgtcgaagacgtgaagcccgtgatacacgctgctgagctggcagaggtcgagtctgacgtggcaaaatcgaacgctgaatatgtttatcccgagttcgaggattttaaggtcgagcacgagaacccaatgttttctggtgaatcttcttcgcctgaatccagtgttactttcttggatttctcggacttctcggattctaataatcagtgggatgaaatggagaattttgggttggagaagttcccttctgtggagattgattgggaagctatatgatgactcggtgaattttcgttatgtcaaatggttggt

SEQ ID NO: 402 - protein, 312 aa, Glycine max
MGTAIDMYNSSNIVADFLDPYSEELMKALKPFMKSDYFSASSSSSLESQPCSFSSNSLPTSYPSSNQIKLNQLTPDQIVQIQAQIHIQQQQQHVAQTQTHLGPKRVPMKHAGTAAKPTKLYRGVRQRHWGKWVAEIRLPKNRTRLWLGTFDTAEEAALAYDNAAFKLRGEFARLNFPHLRHHGAFVFGEFGDYKPLPSSVDSKLQAICESLAKQEEKPCCSVEDVKPVIHAAELAEVESDVAKSNAEYVYPEFEDFKVEHENPMFSGESSSPESSVTFLDFSDFSDSNNQWDEMENFGLEKFPSVEIDWEAI

SEQ ID NO: 403 - DNA, 597 bp, Glycine max
atggcgaaacccagcagcgaaaagccagaggagcatagcgattccaagtactacaaaggggtccgaaagagaaaatggggcaaatgggtatccgaaataagactacccaacagccgtcagaggatttggttgggatcctacgacacccccgagaaggccgcgcgtgccttcgacgcggcaatgttctgcttacgtggccgcaacgccaagtttaacttccccgacaacccacccgacatcgccggcggaacgtccatgacgccgtcgcagattcagatcgccgccgcacaattcgccaacgcggggccccacgagggacattcgggccgacccgaacatcctcccatggaatctccatcgccttctgtttcggaagggaccatccaaacggacagtgacgtccccactcttaacggttcagtaacggatttgttcacgcccgttgggtcgagtggttacgcatccgattacgggattttcccgggctttgatgatttcagtggcgatttttatgtgccggaaatgccgaacgttaattatggagaagaaaacggggaagggttcatagttgatgaatctttcttgtggaatttttga

SEQ ID NO: 404 - protein, 198 aa, Glycine max
MAKPSSEKPEEHSDSKYYKGVRKRKWGKWVSEIRLPNSRQRIWLGSYDTPEKAARAFDAAMFCLRGRNAKFNFPDNPPDIAGGTSMTPSQIQIAAAQFANAGPHEGHSGRPEHPPMESPSPSVSEGTIQTDSDVPTLNGSVTDLFTPVGSSGYASDYGIFPGFDDFSGDFYVPEMPNVNYGEENGEGFIVDESFLWNF

SEQ ID NO: 405 - DNA, 923 bp, Glycine soja
ggctttctcagttccctctttccctatcaaaatcctttcccacaacactactcactccagtccaagaaaccctttttcaatttggtttcaacagcacacacacacacacacatatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggacacaacaacggccacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgatgttacttttttggagtgaacagtgtctgtactggttttttattactagtacggatactagtt

SEQ ID NO: 406 - protein, 234 aa, Glycine soja
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 407 - DNA, 1185 bp, Brassica napus
tgctgcatgaattcggcacgaggagagaaataaatatcttatcaaaccagacagaacagagatcttgttacttactatactacactcagccttatccagtttttcaaaagaagttttcaacgatgaactcagtctctactttttctgaacttcttggctccgagaacgagtctccggtaggtagtgattactgtcccatgttggcggcgagctgtccgaagaagccggcgggtaggaagaagtttcgggagacacgccaccccatttacagaggagttcgtcttagaaagtcaggtaagtgggtgtgtgaagtgagggaaccaaacaagaaatctagaatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggttgaggttaatgacacgacggatcatgacctggacatggaggagacgatagtggaggctgtttttagggaggaacagagagaagggttttacatggcggaggagacgacggttgtgggtgttgttccggaggaacagatgagcaaagggttttacatggacgaggagtggatgttcgggatgccgaccttgttggctgatatggcggcagggatgctcttaccgctgccgtccgtacaatggggacataatgatgacttcgaaggagttgctgacataaacctctggagttattagtactcgtatttttcttaaaattatttttggaatgataatattttattgaattcggattctacctattttttttaatggatatcctttttttctggtagtgtgagaaacgattgtgaatgtttccacaaaagtgttggcaatgttgtcaaatgctgggtattttgtgcagcatagtcatcttggtttccttatatgcagcaactaaattttagtttttaagtaaaaacagaagaggaaagagaatgaatgttattaaataaagaaagaaaaatctaaaggtgggtttagtatgaaaaaaaaaaaaaaaaaa

SEQ ID NO: 408 - protein, 250 aa, Brassica napus
MNSVSTFSELLGSENESPVGSDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQVEVNDTTDHDLDMEETIVEAVFREEQREGFYMAEETTVVGVVPEEQMSKGFYMDEEWMFGMPTLLADMAAGMLLPLPSVQWGHNDDFEGVADINLWSY

SEQ ID NO: 409 - DNA, 945 bp, Brassica napus
aattcggcacgagctgagagataaattaaacatttatcaaaccaacgaaacatagatctttgtacttactatacttcaccttatccagttttatttttttatttataaagagttttcaacaatgacctcattttctaccttttctgaactgttgggctccgagcatgagtctccggttacattaggcgaagagtattgtccgaagctggccgcaagctgtccgaagaaaccagccggccggaagaagtttcgagagacgcgtcacccagtttacagaggagttcgtctgagaaactcaggtaagtgggtgtgtgaagtgagggagccaaacaagaaatctaggatttggctcggtactttcctaacagccgagatcgcagcccgtgctcacgacgtcgccgccatagccctccgcggcaaatcagcttgtctcaattttgccgactccgcttggcggctccgtatcccggagacaacatgccccaaggagattcagaaggcggctgctgaagccgcggtggcttttaaggctgagataaataatacgacggcggatcatggcattgacgtggaggagacgatcgttgaggctattttcacggaggaaaacaacgatggtttttatatggacgaggaggagtccatgttcgggatgccggccttgttggctagtatkgctgaaggaatgcttttgccgcctccgtccgtacaattcggacatacctatgactttgacggagatgctgacgtgtccctttggagttattagtacaaagattttttatttccatttttggtataatacttctttttgattttcggattctacctttttatgggtatcattttttttttaggtaacgtggaagctgagtgtaaatgtttgaacaattgtgttataaaatgctagtatttttgtgtgcaaaaaaaaaaaaaaaaaaaaaa

SEQ ID NO: 410 - protein, 215 aa, Brassica napus
  UNSURE (185)..(185): Xaa can be any naturally occurring amino acid
MTSFSTFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAAVAFKAEINNTTADHGIDVEETIVEAIFTEENNDGFYMDEEESMFGMPALLASXAEGMLLPPPSVQFGHTYDFDGDADVSLWSY

SEQ ID NO: 411 - DNA, 1061 bp, Brassica napus
aaattatacaaaaagagttcgagctcttgattacttaattaaaaacaaattttacttctcttttttttatggtcttttgtcatgatctgaaatacggtctttgttgataaatcatatatgccgattttgatttttaatccacctgagagataaattaaacatttatcaaaccaacgaaacatagatctttgtagttacttatccagtttattttttaaaaaattataaagagatttcaacaatgacctcattttctaccttttctgaaatgttgggctccgagtatgagtctccggttacgttaggcggagagtattgtccgaagctggccgcgagctgtccgaagaaaccagccggtcgtaagaagtttcgggagacgcgtcacccagtttatagaggakttcgtctgagaaactcaggtaaatgggtgtgtgaagtgagggagccaaacaagaaatccaggatttggctcggtactttcttaaccgccgagatcgcagctcgtgctcacgacgtcgccgccatagccctccgcggcaaatcagcttgtctcaattttgctgactcggcttggcggctccgtatcccggagacaacatgccccaaggagattcagaaggcggctgctgaagccgccttggcttttcaggctgagataaataatacgacgacggatcatggcctggacatggaggagacgatcgtggaggctattttcacggaggaaaacaacgatgtgttttatatggacgaggagtccatgttagagatgccggccttgttggctagtatggcggaaggaatgcttttgccgccgccgtccgtacatttcggacataactatgactttgacggagatgctgacgtgtccctttggagttattagtgcaaatttttttttcaattttttcgtataatattcttttggattttcggattctgcctttttatgggaatctttttttttttggtaatgtggaagctgagtgtgaatgtttaaacaattgtgttatcaaatgctagtatttttttgtgcagcctcgtgccgaatcctgcagccc

SEQ ID NO: 412 - protein, 214 aa, Brassica napus
  UNSURE (54)..(54): Xaa can be any naturally occurring amino acid
MTSFSTFSEMLGSEYESPVTLGGEYCPKLAASCPKKPAGRKKFRETRHPVYRGXRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 413 - DNA, 879 bp, Brassica napus
cccctcgaggtttgttcgcctctagttccagaggccagtataaaaaacaccaactctcactcccaacttttttatcgaactacaaactttagaatccacctgaaagataaaataaacatttatcaaaccatcagaactgagatctttctagtctcttactatacttaaccttatccagttaacaatgacctcattttctgccttctctgaaatgatgggctccgagaacgagtctcctgcattaagcggggagtattgtccgacgctggccgcgagctgtccgaagaaacctgcgggtcggaagaagtttcgggagacgcgtcacccaatttacagaggagttcgtcagagacactcaggtaagtgggtgtgcgaggtgagagagccaaacaagaaatccaggatttggctcggkactttcctaaccgccgagatcgcagctcgtgctcacgacgtcgccgccatagccctccgtggcaaatccgcctgcctcaatttcgccgactcggcttggcggctccgtatcccggagacaacatgccccaaggatatccagaaggcggctgctgaagccgcggtggcttttcaggctgagataaatgatacgacgacggatcatggcctggacgtggaggagacgatcgtggaggctatttttacggaggaaaacaacgatgggttttatatggacgaggaggagtccatgttcgggatgccgtccttgttggctagcatggcggaagggatgcttttgccgccaccgtcggtacgattcgaacataamtatgactttgacggagatgccgamgtgtccctttggagttattaatacagagattttttatttccagtttttgtataatactttttttttggatt

SEQ ID NO: 414 - protein, 214 aa, Brassica napus
  UNSURE (200)..(200): Xaa can be any naturally occurring amino acid
  UNSURE (208)..(208): Xaa can be any naturally occurring amino acid
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLLASMAEGMLLPPPSVRFEHXYDFDGDAXVSLWSY

SEQ ID NO: 415 - DNA, 753 bp, Brassica oleracea
atgaactcagtctctactttttctgaacttcttggctctgagaacgagtctccggtaggtggtgattactgtcccatgttggcggcgagctgtccgaagaagccggcgggtaggaagaagtttcgggagacacgtcaccccatttaccgaggagttcgccttagaaaatcaggtaagtgggtgtgtgaagtgagggaaccaaacaaaaaatctaggatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggctgaggttaatgacacgacggatcatggcctggacatggaggagacgatggtggaggctgtttttactgaggagcagagagacgggttttacatggcggaggagacgacggtggagggtgttgttccggaggaacagatgagcaaagggttttacatggacgaggagtggatgttcgggatgccgaccttgttggctgatatggcggcagggatgctcttaccgccgccgtccgtacaatggggacataatgatgacttcgaaggagatgctgacatgaacctctggaattattag

SEQ ID NO: 416 - protein, 250 aa, Brassica oleracea
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDADMNLWNY

SEQ ID NO: 417 - protein, 219 aa, Oryza sativa
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 418 - protein, 153 aa, Arabidopsis thaliana
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 419 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 420 - protein, 328 aa, Arabidopsis thaliana
MDPLASQHQHNHLEDNNQTLTHNNPQSDSTTDSSTSSAQRKRKGKGGPDNSKFRYRGVRQRSWGKWVAEIREPRKRTRKWLGTFATAEDAARAYDRAAVYLYGSRAQLNLTPSSPSSVSSSSSSVSAASSPSTSSSSTQTLRPLLPRPAAATVGGGANFGPYGIPFNNNIFLNGGTSMLCPSYGFFPQQQQQQNQMVQMGQFQHQQYQNLHSNTNNNKISDIELTDVPVTNSTSFHHEVALGQEQGGSGCNNNSSMEDLNSLAGSVGSSLSITHPPPLVDPVCSMGLDPGYMVGDGSSTIWPFGGEEEYSHNWGSIWDFIDPILGEFY

SEQ ID NO: 421 - protein, 330 aa, Arabidopsis thaliana
MAVYEQTGTEQPKKRKSRARAGGLTVADRLKKWKEYNEIVEASAVKEGEKPKRKVPAKGSKKGCMKGKGGPDNSHCSFRGVRQRIWGKWVAEIREPKIGTRLWLGTFPTAEKAASAYDEAATAMYGSLARLNFPQSVGSEFTSTSSQSEVCTVENKAVVCGDVCVKHEDTDCESNPFSQILDVREESCGTRPDSCTVGHQDMNSSLNYDLLLEFEQQYWGQVLQEKEKPKQEEEEIQQQQQEQQQQQLQPDLLTVADYGWPWSNDIVNDQTSWDPNECFDINELLGDLNEPGPHQSQDQNHVNSGSYDLHPLHLEPHDGHEFNGLSSLDI

SEQ ID NO: 422 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 423 - protein, 216 aa, Arabidopsis thaliana; identical to SEQ ID NO: 422

SEQ ID NO: 424 - protein, 302 aa, Arabidopsis thaliana
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGLNQDRYPGNSVANGSYRPESQQSGFDPLQSLNYGIPPFQLEGKDGNGFFDDLSYLDLEN

SEQ ID NO: 425 - protein, 218 aa, Arabidopsis thaliana
MIASESTKSWEASAVRQENEEEKKKPVKDSGKHPVYRGVRKRNWGKWVSEIREPRKKSRIWLGTFPSPEMAARAHDVAALSIKGASAILNFPDLAGSFPRPSSLSPRDIQVAALKAAHMETSQSFSSSSSLTFSSSQSSSSLESLVSSSATGSEELGEIVELPSLGSSYDGLTQLGNEFIFSDSADLWPYPPQWSEGDYQMIPASLSQDWDLQGLYNY

SEQ ID NO: 426 - protein, 216 aa, Arabidopsis thaliana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 427 - protein, 196 aa, Arabidopsis thaliana
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

The invention claimed is:

1. A method for increasing biomass and/or seed yield under conditions of reduced nitrogen availability in a plant relative to a corresponding control plant, comprising:
   (a) introducing and expressing in a plant a nucleic acid encoding a NAP1-like polypeptide, wherein the NAP1-like polypeptide comprises a NAP domain comprising the amino acid sequence of SEQ ID NO: 33 and SEQ ID NO: 34, and wherein said nucleic acid comprises:
      (i) a nucleic acid sequence encoding a polypeptide comprising an amino acid sequence having at least 80% sequence identity to the amino acid sequence of SEQ ID NO: 2; or
      (ii) a nucleic acid sequence capable of hybridising with the complementary nucleotide sequence of the nucleic acid sequence of SEQ ID NO: 1, under stringent hybridization conditions comprising hybridization at 65° C. in 1×SSC or at 42° C. in 1×SSC and 50% formamide, followed by washing at 65° C. in 0.3× SSC; and
   b) selecting for a plant having increased biomass and/or seed yield under conditions of reduced nitrogen availability relative to a corresponding control plant.

2. The method of claim 1, wherein the increased seed yield comprises increased total weight of seeds and/or increased number of filled seeds.

3. The method of claim 1, wherein the nucleic acid is operably linked to a constitutive promoter.

4. The method of claim 3, wherein the constitutive promoter is a GOS2 promoter.

5. The method of claim 1, wherein the nucleic acid encoding a NAP1-like polypeptide is of plant origin.

6. The method of claim 5, wherein the plant is a dicotyledonous plant.

7. The method of claim 5, wherein the plant is from the family Brassicaceae.

8. The method of claim 5, wherein the plant is from the genus *Arabidopsis*.

9. The method of claim 5, wherein the plant is *Arabidopsis thaliana*.

10. The method of claim 1, wherein the nucleic acid encoding a NAP1-like polypeptide comprises a nucleic acid sequence encoding a polypeptide comprising an amino acid sequence having at least 95% sequence identity with the sequence of SEQ ID NO: 2.

11. The method of claim 1, wherein the nucleic acid encoding a NAP1-like polypeptide comprises the nucleic acid sequence of SEQ ID NO: 1 or a nucleic acid sequence encoding a polypeptide comprising the amino acid sequence of SEQ ID NO: 2.

12. The method of claim 1, further comprising obtaining a seed or progeny from said plant having increased biomass and/or seed yield under conditions of reduced nitrogen availability relative to a corresponding control plant.

13. A method for producing a plant having increased biomass and/or seed yield under conditions of reduced nitrogen availability relative to a corresponding control plant, comprising:
   1) transforming a plant with a construct comprising:
      (a) a nucleic acid encoding a NAP1-like polypeptide comprising a NAP domain which comprises the amino acid sequence of SEQ ID NO: 33 and SEQ ID NO: 34;
      (b) one or more control sequences capable of driving expression of the nucleic acid (a); and optionally
      (c) a transcription termination sequence,
   wherein one of the control sequences is a constitutive promoter, and
   wherein the nucleic acid encoding a NAP1-like polypeptide comprises
      (i) a nucleic acid sequence encoding a polypeptide comprising an amino acid sequence having at least 80% sequence identity to the amino acid sequence of SEQ ID NO: 2; or
      (i) a nucleic acid sequence capable of hybridising with the complementary nucleotide sequence of the nucleic acid sequence of SEQ ID NO: 1, under stringent hybridization conditions comprising hybridization at 65° C. in 1×SSC or at 42° C. in 1×SSC and 50% formamide, followed by washing at 65° C. in 0.3× SSC; and
   2) selecting for a plant having increased biomass and/or seed yield under conditions of reduced nitrogen availability relative to a corresponding control plant.

14. The method of claim 13, wherein the constitutive promoter is a GOS2 promoter.

15. The method of claim 13, wherein the nucleic acid encoding a NAP1-like polypeptide comprises a nucleic acid sequence encoding a polypeptide comprising an amino acid sequence having at least 95% sequence identity with the sequence of SEQ ID NO: 2.

16. The method of claim 13, wherein the nucleic acid encoding a NAP1-like polypeptide comprises the nucleic acid sequence of SEQ ID NO: 1 or a nucleic acid sequence encoding a polypeptide comprising the amino acid sequence of SEQ ID NO: 2.

17. The method of claim 13, further comprising obtaining a seed or progeny from said plant having increased biomass and/or seed yield under conditions of reduced nitrogen availability relative to a corresponding control plant.

* * * * *